United States Patent 12,642,819 (COMPOSITIONS AND METHODS FOR TREATING INFLAMMATORY BOWEL DISEASE) - sequence listing, part 77

SEQ ID NO: 38 - DNA, 3565144 bp, Coprococcus comes (residues 1,782,573-3,565,144 of 3,565,144)
  modified_base (108176)..(108272): a, c, t, g, unknown or other
  modified_base (551739)..(551837): a, c, t, g, unknown or other
  modified_base (1700983)..(1701082): a, c, t, g, unknown or other
  modified_base (3240460)..(3240559): a, c, t, g, unknown or other
ttgtcacaaagagtatgattgatatgtatgatatgcgcaagatttctaataaaaaactgcgggtctatatgactaattatcttgcaattatgatgacggtgtcttcgattcttctgattcgttccaaaaatgcagagaatctggaaaagaaacgggagctgtggcagtatctgaagaagaatcactacggaacttattggaagatccgttacggaatccttggacagaccatgaatcttccgggcagatcaggaagaaagatttcgtctctggcgtacattgtggcgagaagaattgtaggatttaattaaaattcgttcttgacatttccgaagagaagactataataacgattaaagaaaatatggttcaccaaaattcgttgatgagaacaaagtcgtatccgtcattattttcagagagcctgtggatggtgtgaacaggtaataaccggataaggatatcctctctaagaagcaggttcaaagcagaaaagtatctgcaagtagacttcgccgggatccaccgttatatggatagcatatgttggtatgtgaagtgccacagattattttctgtggaattagggtggtaacgcggattttattcgtcccttttcagattgattctggaaagggacttttttgtttcataggaagttcctatgaaacaaaaggcacattcctttttattgctgtgtatacaaaaaatcctgtgaattttgttatcggatgattagaagaacagttttgcgtggacgaaaagaaaaaggaggaaactgtaatgaaagcattacaaaaagcaagcaaatttttatcagactatacatcagtggtggtaatcgctattgcagtagtcacattctttgtaccggcaatgatgggatgggtaaataacccattgttcgttgatccggtgtccaacaagttcacttgccagtcgatcatcatcggaatcattatgttcagcatggggctgacactgacaaccaaagattttaagattctggcacagagaccttttgatatctgtatcggcgcaatcgcgcagtatctgatcatgccatttcttgcatttgcgctgacgaaagtacttcagcttccggatggaattgcacttggtctgatccttgtaggctgttgtccgggtggtgtatcctccaatatcatgtcttatctgtgtggcggagatgtggcattttccgtaggaatgactacggtatccacaatcatttcaccggttatgacaccgcttatggtttcacttcttgcaagcggaacacatattacgatcaaaggacttccgatgtttgtatctattgttgagaccgttattgttccggtagcttttggatttttactgaattatctgtttggaaagaaaaaaacatttacagagcttcagaaagtaatgcctggagttgcagtacttggacttgcatgtgtagttggcggagttgtttcttcgcagggagacaaattctttgaatcaggagttgtaatttttgtggcagtatttcttcataatggacttggatatctgctgggatacggcgcaggaagactgactggtatgaatactgcaaagaagagaacgatctccatcgaagttggaatgcagaacgccggacttgctaccaaccttgcaactacaacggcacagtttgcggtggcaccggaatctgcaattatctgtgcagtatcctgtacatggcattctatctcaggaacacttctcgcaggattatttgcagcatatgataagagaaaagcaggaaagcctgcaaataaaaagcaggctgcagaaaatgtagcataaaatacagaaataatttcggaatggtcatcataaaatatcaggaataacttacagggcgtaagaagttatgaaagatcagaagctggaaaatcttttaaatctggcacttggtgcaacagaagaggaaagagagaaatctttgaatctggatgtcggttatcatccgattgacagggaatgggaattgattattaaatattcgggcaatctggaccaggtaagagatctggcgagccaggtggttgagcttcagaatgagtacgcaatcattcggatcagccgatctggaattgatagactttcagatattccggaggtagaatatatagaaaaaccgaaacgtttattttttcaaatagcaaatgggaagcgggtatcctgtatcaatgaggtacaggatacccgctttcttgatctgcgtggacagggtgtacttgtggcgataattgattcggggattgattatgcgaatgaagattttcggaatgcagatggaacgacaaggataagggcgttgtgggatcagtcgctaatatcggatgagaatgaagagaagaatccaccaaaaggttatcggatgggagtggaatttacccaggagcagattaacagggcacttgaggctgcttcgacagcggaaaggagaagaatggtgccaagtcaggatatatccggtcatgggactcaagttgcagggattgctgccggaaatgggcgaggaagcggaaagctatatgtcggtgtggcgccagacagtgaattaatcgtagtaaaaatgggttcacctatgccagatggatttccacggacgacagaactgatgcaggcattggattatgtggtgaggaaatcgctggaggtgcggatgccggtggcgatcaatctgagctttggaaatacctatggctctcatgacggaagaagtctgttggagcggtatattgatgatctgtcgaatttctggaagagtgtgatctgtgtggggacaggaaatgaggcagcaagtgcaggacatacgtccggggtgatgcaggaaaggaaggaagaaaggatacagcttgcagtacagtcggaagaaccaacgctgaatattcagatctggaaagcgtatacggacgaagtggaaatttcattcgtatctccgacagggacgcggattggcccgattcagtctgttctcggcccacagagatttcggattggagatacggagattttattatattatggaaagccgagcccgtataatgtggcacaggaaatttatattgatatgattccggtgacgaattatattacgtcgggagtctggcagattatcctgaatccgacaagggttgtggaaggacagtatgatctgtggctgccaagtgagaatgtactaaaccgggggacgggatttctgtatccagatgaagaagtgaccttaacgatcccttcgactgcggaaaaagtgatatcggtgggggcgtatgatgcgcttactttttcctatgcacctttttcaggaaggggatatacctggcaggatgaaaggacgaagccggatcttgtggcgccgggagtgaatgtcaggacggcagcagttggcggagggatgactacggtgagtggaacttcttttgcgacgccttttgtaaccggagcgtcggcacttttgatggagtgggggattgtgagagggaatgatccgtttttgtatggggagaaggtgaaggcgtatctccggcgcggggcgagagagctgccgggatttgagaagtatccgaatcgggaggtggggtatggggaggacgttataataaggttacattgaagaaagtcagtaaaatcaagggtttccgttcattttcccaacacagaaacgaagcacttttaccatgattttgaagaaaatctgcccgggttggattcaaaatgatatggaaagaaagatttgtagcaatgacgtaacatgaacagttggttctgttacagataaaagtttaaacgaaagagaggtcatagggatatgaaactgacttatacaaatgtaaatggatacctgattccgaatctcacctataaatccggtgagcagatggagcaacttggcaaatatggatttcttcgcagagattatctgaagaaccatcgaaactcaacgtatcaggtgatgctcttacaggataccattggagagcatcttctggaagtggacaaggcagctagggaacgggaggaagtgattctgaaacagttggaagaaaaagaaccactgccggataaggagaaagatcagatggcatgggtaagagctgccaatcagcacagagcgattgcagaagagattatcctgaaagaattgatttatgtataaggatagtcagtaatcaatctggcaggtaactgataaaaatagaatattgtgagtgaagtaaggcgtgagtcataaaatatggcttgcgtctttttctttgcctgaaaggaagtgataagtttgaacaagaagtttttgaagcattatatggaaaccaatccagaagggacagcacaaacctatatctttctggtggacaatcaggatatagcgttgaatattgtaatgtcaggatatcaggcaatctgtctggtgcaggaagatgacggatattatttcagtgcagattcttttatagaggaaatgaggtctattcagtttactggaagctgtcagagtgcctatcattatgtggctgcctgtacagtgaagtggatgaatgataagttacagatatttttcaaagacgctggtcttgatggaaaagcaggctggcagttgttcaaagagaaagagtaccttggcaaattggataatcagaaagaagttgagaaactactggaacagtatattcttcggtttgaacgagaaccgaaagaacaaccggaactgagccgttttcatttatttgatgcaaaagggaatgtgaaaggcgtccaggatatggagattgtagattatctggtggagaatgttcagttttttgtggtaggaattacaccttattattatgaacatggtgcctattgggaagatcataatggggtgagaatgaaataccgtatacagaagctgatctatcgagatcagatacagagtggcgtaattaaaagaatttataatctgctgattacacagccgaaagttcacagggaggcatatgaactaaataagcagcctgtgcggtggattaattttaaaaatggatattatgatccgattacgggtgaaatgctggaacacaatccggattatctgacaatcaatcagataccatttccctattatccggaagacagagagcaggtgatgcagggcggcgaaaatatcaaaaaatatcttgcatcctctcttccaaatatagaagaacagcagatgttctgggagtattttggatactgcatgacacaggatacgcagtttcagaaattccttacactgaaaggaaatggtggaaccggaaagtctgtggcagtatcgctgattcagcatgtagttggaatcaacaatatgtccagcatttctttacaggatttaaataaacgattctatgcgactggaatgtacggaaagctattaaatgcctgtgcggatattccatgcaaggcaatggagaatacagatgtattaaagaaagcagtcggtgaggacacactgatttatgagaaaaaaggacaggatgcaattcatttccactcttatgcaaagctgcttttttctaccaatgaaatgccacagaatcttgaggacaagtcagatgctttttatcgtagactactgattctcgatatgaaccgggtagtaaaaagtggtgaaaaagatctgcacttaaaggaaaaggtacaggcagaatccgattatgcaattcatatggcgatgattgcattgaaaaatctgtacgaacagggaaagttcacggagagcgaacacagcaaagaatgtgtaagagaagtgcaacggacgtcagatagtatctgtgcttttattgatgagtcattggtgcgtgccaaagggaaacgtctgaaacgaagtgaagtgttccatatgtatgaggaatactgcaaagagaatggcagacaggggcatggtaaatccaactttttcaggaatatgacagataaaggtttccttctgaagcagtataatggtgagttctattatcaggatattgcagttaaggaagaagatttttgtcctgtagatccagaagaaagaataccttttgaagaaacagatatagattataaacagttacaattaaatatgaatcagggaattaagggcatttagggcaaaataagcaaaaagaaatgttaccggagcaggagaaataacaaagatagctgccagagtacataaaattttgctttttttacactgattgccctttttcaggtatcaacgttttagctgatacaaatataggtttttcccgaatttgggagaaagtcaaaaataaatattaagaaagtatgaggtatgattatgagaatgatgaaaaacaacaataatgagacagttatggtgatcgggattgatcatgggtatggaaacatgaaaacagccaccagatgctttccatccggtgtagccagatatgacaaggagccaatcttccagaataatcttcttgtttacaatggcatgtattaccagatcggagaggaacacaaggagttctgtgcagagaaaacgcaggacgaggactattatgtgctgacactggcggctatcgcaagggaactggatgggaaaggtatgaaccgggcaaaggtacacattgcagccggacttccacttacctgggtagctacacagaaagaagatttccagaaatatcttctccagaatgaatgtgtggattttacattccgcaataaagaatatcatgtggagtttgcaggagctgatatttacccacagggatttgcagcagctttttaccgtttacaggatttcaaaggaatcaatatgctggcagatattggaaatggaactatgaatatcatgtatatcaataattcccgtccattagagaagaaatgctctacagagaaatatggaacgcatcagtgtgtgcttgctgtaagggaatccctgttgaaagaactgggaacagtggtggacgaactggtgattgagcaggtgatccgtaccgggacagcagatattggcgagaaatatctgacagtcattcgtaaagctgccggagattatacgaaagaaatcttccataagttgagagaacgggaatataatccagaactgatgcgtttgtatgtggtcggcggtggcggttgtatgatccagaattttggagaatatgacaagagccgggtgacaattgtacgggacatctgtgcaacagcgaaaggctatgaagcaatgaccgtaaggaaaatccagagaaacggagggatgcttgtatgagaaaagaacggaaaatcatcaacaccaatatccgtttgaatctttgtgatgaacagggcaggcaggcatgggaatatttgcagacgatggacaggaaaaaatataaatcgtacacaagagcagttgtagttgctttaaacgattatttttccagagagtaccggaatgaagcagatccgtatctggaaaccagagaaaaggaagatgcttttctggaaagggtggaaacagctatccgggatggagtaaaagaatccgttccgatggctatggcgaagaacctgattgaaatgcttgtaccgtttgtaaaagaatcggtaggagaaattaatctgtcggacagaacactaacaatggagaaaacggatggagagatcgcagaagataatctggactgggagaaagaagctgatatggatgcagcactggattttgcggatagtttttagctgtctgtaaaaaggaaaagcagtccggtttgcataaaataaatcggactgccttaagtggagctattcttttttcttgggtaaggacgtttatcatctgtcaggtttagcagatagtcaacgctggtgttatgaaattcagccagtttaatcagaatgtgagtagggatatcgacatcaccacattcataattactgtaaatacgctgactgcaattcagaatttcacccatattcttctgcgtaaggtcacgatcttcacgcagatcccgtattctctgatacatgcgtttcacctctagcataataataacttagcgagatattcactattgaaatatagcgagaaattcgctacactgaatttaaaaatgcagaagggagaagtacagagtgaaagagaaagtgaaaaaggtgctggtgtggatttttgaatttgttttattttgtggatatttctatgttttattcgtgaatctggtatgtggatttggatatggagggataagcagcagaggacaggcaataaagattttatgtgcttcgttcttccttgcagtgggacttcccggattgatctggtatcagcatcgcagacttatgaaactggagaatttattgcatgacctgtttgaaatttgcgacaaaataaaatagcagtaatagaaaaatagactgacagtaaggaaagctttacggaaacagaatagcagaaaaaggtaatggcagtgatggcatttctattggtaaaaatcagtgaaatgttcatgactgctatttttatgcttttcagcagaaatggaaagtgattcagaaaaagaaaagcagaaataacagcgaaatatggcagagagacatttgcagatggaaaacgttgtataagcaaggcaaagaagaaatatagagtgctggatacggcacatgattgtccgatacttcgcatcggagtggtgcatgactagcctgtttcagaaaggaaaaatctatggaatgtggagattttctctttcttttacagtcagttcctgcaccacaaaaccactgtcatctcaattttggattaataacgcagaggagaatgttgcttacttggtgctggttcagtggtggggagatgacaggcaagtttcgcaaagtggcaagccactctgcaccggagccagcctttgggctgttcctaaacttgccagagggctctgccccttggaaccccggcacgtcaatgacgtaagtatttctgcgaaatgtccaccggacattcctacggaatacttactgattgactaggactctgtcctgcacctgtataagagagcgttgcactctcttataaatctcctgccaatatgccgccagaacgctgtggctgttaacaaagaatgaaaatcaagcaatgaaaggagacaaaagcctatgagaaaacgaaatcatacagtaaccatacggatgaataaagaggaatacgatttgtttcagagcaaggttaaagaatccggaagaacacagcaggaagttgtgataaaagcaatcgcagacttgaagatagcatcggcagaggaaatagaagaactgaaaagactgaaccagatgtttgcggatatcctttgtcagctccggggagctacgacaaatatcaaccagattgcaagaaaactgcatacagatggagaaatcccaaacgacagtatgttgtatttcctcaataaaaatattctcaagtatcggaaggagagcgaaaggatatggcagttaataagacgattaataagcggacaaatacacatggagcaatgagaaattgtattgaatatattttacggcaggacaagacaagtgagctgcttacttatataacaggcccgtactgtcacaatgaaattaattatgatctggtgtacagaacctttttggaagaaaagaagatgtggaataaagatacagggagaatgtatgcccacaacattatttcctggcataaggatgagcagatcaccccggatcaggcatttgaatttggaaaagagtttgcagaaaattggttcagtggattccagaccttagtggctgtgcataaggataaagaccatatccactgccatttggttactaattcagtgagttatgaagatgggagaaagctgcataacaccagaaaagatctggaacgtatgaaacagcttaccaatcagatgtgccgggaacgaggactgaccgttgccgaaaaaggaaagcattttgatggaagtcagattgaaaaaggggaagtcattgcatggagtaaagacaaatataatctgttccgtcagcaggtaaaggatagctttgtagcggactgtgcaatggcagtgttaaaagcactggaaaattgtatcagcaaagaaaagtttatagaaaaaatgaagcagttcggatggaacgtaaactggacagagaaacggaagcacattacttttcagaaccaagagggaaagaaagtacgtgacagtaatctgttcaaaacatttcatttggatatcagcaaggagggactagagaatgaatttaatggaaataggaaaaaatccagagatattgaaatcagagacagcagagcagccgaagaactcagaaattattacagagaacttgacacagccatcgcagctgccggaggaatcaccgatcaagctcaaagtagaaagagatctcctaatgcagagtttcgagagagcgaaagagttcatgcggacacagaaaaagcagatacagatgctggaagaagagaaacagacgatcttatccgacaggcagagattgcgagaagaagttcggaaatcaaccgtagaaattcagtgtctgacaaccgaattgtccgaaacgcagaagctgaatcaatcgcttcagcagagcaacgacgatctgaggaacagaaatggattaatgagcaggagcgagcaggagcagctcgaagaagaaataagagacgttcgggaccagaactctaaactacaaatacaggtgaacaaatcatctgttgaagcagtagatgatgcacagaagaaacagaaagaagcagagaaaaagatggaacaggcagaagcaaaagcccgtaatgaaaagaaacgtgcagagatggaaatccgtaaaacgaaaaaagaagtaaaggccagaaccgaaaaaatgagggacgcagaatatttctggggaataggatacattacagtaatcctgtttgcaatcatacagaatggtgcttttcagcatgatttcatagatttttttaggattccattcacatggtatgttcgattttgtgaatggttggtatatccgacttatgataatgggttcaatcagaaaatagcttatacggggggagaagcctgggttatcaggattttggcaatcgtagctataatttttatattggcaattatgatagtaatgattgtagaagcaataaaacgatacaaaaaaatgtggaatgaaatttcacagatatttttaattggaagtctttcaggaataacagtgcttggagatgtaactagaaaatatctgccggtgaatttgattttgctatttatactcattaatatgggtatcatgctactcagaatatatcttcggaagaagtttgattatatgtaatttgttattttaatgaccagtgggtggtacctgacaaatgataaagctgttattatgattgcacaccgcctaaaaacagtacagaaagctgaacggattttcgctctggagaatggaaaaccgtacagcagggaatacatgaagaacttgtgagacaggatgggatttatcgtcattttattgttgaaagaagagaggcaacaaaatggagagtttaggagtctaaatgtctggtgcggcgatattccaaaggtgatacaccaaaatgctttttaaacacagaggcgaatttgctctgattcagatatccgacctgtgctgcaatctcagctacagacagtcgtgttgaggcaagcagttcgcctgctttattcatacgcatttcacgcagatagacagaaatattctgtccgtaaacaccgcgaaaataattttttagactggtttcgctgatagaaaaatattcagccaatttccacgcaggatgatgcagccttaggtctgatgtgatgatattttcgacctttttagcaatattaacctgagattcagtaaagaaagtgcaggcctgagacttagggatagcctccaaattttgtagtactgagaataaagcgagcgtatatattttcatttgaatgactgcaaaagaggccggaaaatcatataattcccatagttttttgagaatttcctcagtttcgtgggtcgctgtcgatatataagtgcttccatgaggacaaaacatctctgagatttttctgaaatcaatgctaaattcattttgtacccatgtattttctaaagtaaatgtatctatatcaataaagaattcaagcccctcatagatgcgctttggataaacatattctttttgggcgaagcattctgtgagagaaagttctctgtctttgatgtagacaaaatttttgttgttcaggatcatttcacaacgacctgtcacacaatagttaagaagcaatggaccttttgtaatggagctgtctgatcgaaggtcgggagccgtccaggttggagaatttataaaaatatatgccagagacagaccgggaaaaagtgaaaaaaaggtcatcgaacctttaccttccttcgtatttaatataagctccatactatattcagcctgttttatggatatacctggtattttgatacattttttgatcacgtcgttaattttcatagaagatctccctgatataagtacttttgccctgtaacagataatattataggatttgaagagagcagagtcaacaataaaacccaatgctgtttggagctaaaatgatatttggttgtagagatataacaaaacatatggtattttatggagtagttagatagagctaattatacaagggaggtattctgtatgaataacaaattacaggcgaaggacctgattaatctgggacttttcacagtcctttattttgtactcggatgttgtgtggcaattccgattggctttgttccgatatttcttccgattcttggtgcattgtggacactgatcacaggaattccatttatgttattcctgacaagggtaaagaagtttggtatggtaacgctgatggcaattctgagtggccttttgatgggacttaccggaatgggatattggggtgtacctttggggcttatctttgggctgctgggagatttgattctgaaatttggcaattataaaagtgctaaaaggagcctgattggatatgcagtattcagtctctggatggttggtacatatattccaatgtacttcatggtagaagattcaagagccagcttcgcagccagttttggtaaagagtatgcagataaagtaatggctgtcatgcctatgtggagcattgttcttgtgattgcaggtatctttatctgcgcaatcattggaggaatgattggaaaagcgttgctcaaaaaacactttgtaaaagcaggaatcgtgtaatggatgagatattatctgctactgttgacagcagaaatggaattgttttagatcctagaacaaaattgtttatgcttataacgattacaacattgatgttcagtaccagcaatgatggaatcatgaatatagtgaaaccaatactaagccttataccatttgcattgattttgtcagagcacaaattcaaaacagccggtaaatatgcagttctctatgcggtatgctttgtactggagcggctggcattgaatgtttggagtggtatgatttcttttctggtattggcagcaacatcaattatgacgcgttttgcaccgggaattatgacaggtgcatatctgatttcttctacatctgtaagtgagtttatcagtgcaatggagcggatgcatgtcacagaaaaaatcattataccgttgtcagttattttccgtttctttcctacaatcaaggaagaatatcaggcaatccgggatgcaatgaaaatgagaaatatccgttttggtggtaaaaatccattccttatgattgaataccggctgataccattgatggtatccgtaataaaaattggtgatgagctgtctgcagcagctctaacaaggggacttggtgcaccgatcagaagaaccaatgtctgcgagattggctttcatgtacaggattttattgccattgttgtttgctttgcatgctttatattgttctttttgcatcagtatattgttttttgaggtagtacattatgataaaaatagatcatgcaacatttacatatggagaaaataatgaatattctgtgggaatccgggatattgatctggagatagaagatggtcaggttattgtgctatgtggggagagcggttgtggaaaaacaacactcactcgaatgatcaatgggttgattccacattattatgaaggaaaattaactggtgagatatggataaatgggataaatgtttcgcagcagccactgtatgatacagcaaaaattgttggaagtgtttttcaaaatccacggtcacagttttttaatgtagatacaacaagcgagattacttttggatgtgaaaatcttggaatgccaaaggaagaaatcaaagatcgattgcaggctacaattcaggagctgcatctgaaaaaattgattggacgcaatatttttcagctttcaggtggagagaagcagaagattgcctgtgcaggggtttctatcatgaaaccggatatttttgtcctggacgaaccctcttctaatctggatgcagcttcaatcatggatctgcgaagaataatcgcccactggaaggaacagggaaaaacgattattatatcggagcatcgcctgtattatctgcgtgggctggcggatcggtttatttatatgaaagagggacagattattcaggattattcagccacagagtttgaaaatctgacagaagaaaagcggggagagatgggactgcgggcttatgttctggaaaatctccttatgccagagatgttgatatcagaaagaaccacaatggagcttcatgattttaattttgcatataagaatggcccacagattttatatatcagagaatgtgagattccggcaaatcggattgtcgcaattacgggcaataatggagctggaaaatctactttttcccgttgtttctgtggtttggaaaaacaatgtggcacaatcatctggaatggaaaaacttacagaccaaaagaaaggctgaaagcctgttatatggtcatgcaggaagtaaaccatcagctttttacagagacaatacaggatgaagttatgatcagcatgaaagaagaaaatgagaaagaagcagacaaatttcttgaaatgctggatctgataaaagtcaaagaccgtcatccaatgtcactttccggaggtcagaagcagcgggtggctatcgcatctgcaattgcctctgggcgctctgtgctgtttttggatgaaccaaccagtggtcttgatcataagcatatgctggaggttgcagaggttctaagagaagtgcgggatgccggaatttcggtttatgtgatcacacatgatttggaactgattatagagtgttgcactgatgtcattcattttgaaaatggaactattgcagatcagtatcagatggatgcagaaggaatggagaagataagaaaatattttatgcagggaaagtgttgtggcaagtggagtaaatctgactgatggcaaaggatattgtaaatagttttggaaagtagatgaatgataattatgagcaaatataatcctttatggaagtggatcaataaaaataaaacagacagtagattttgaaaaagtcgaagaggaggcttaaacatggaatcaaagaaatagaacttgtagttgcatcttcgattggtgcagatcttgccatggcatttctgacataggcaaaaataccgttaaagcatgtattttttgatggtggacagtttgtacaaattggaaaggcaacacgcagaatcatggttccgttcttatatatagcaatgaaaagtttatattggtcaaaaggaaaaatactgaagagaatcatgtggtgtgacgacggcaaaatcaaactacagatgcatctgctatgtgaaaattgaatacacgggaaaataaaaaatcgaaacagcagacttgacaaattcctgtaatgagttaaaatataacagtgctatatagcactgttatatttttgaaaagaactttagaggatacgaaaagaatgtcgacaaaagcagaagatacacaaaaaaatatattaaatacagccagaaaacatttcctgaaagatggtctgaccggagcatctttaagaaacattgtaaaagatgccggacttactactggtgcattttacaaatattatccgacgaaagaggcactttttgatgcactgacagatccctatatggaacacatttatcagatttatgatcagatcgttgaggagtttgaaaagctttcagccagtgatcagacaaggaatatgtcggatacatccagtgatggaatggagcagatggttgattatatttatgatcattatgataatttcagattattgttgaaatgtggagacagtggaaaatttgaactattcatacacaatatggtagaacgggaaatgaagtccagcctgaaatatatggaaaagatgaaagagaacggtgtgaaaataccgattgtagaggaaagccttatgcatatgatctatacgggatttttttcatcagtatttcagatcattgagcatgatatagacagggagactgcaaagaaaaatgtgcatcagctgaaagaattcaatacaggtggctgggaacgattgtggaatattgaattcccggtattactaatgtaaatcaggtggctaatgccagtaagccacctattttattatatatgagttagaataaactaatgaaagaaacaacaataaaaccaaagtaaggagtgaacgaatgtgaaagaaaaaaagaagtcggcagtcagctggatcctgacatgggccggacaaaaaagaattgcctatgtatggagtgtgttacttgcaatcggaaatgtgatttttaagattttgccgtattttattattgcagatatagtaaagctgtttttaaatggtgaaaaggagtttgaaatatatcttgcaaaagcggttctgattgcattatcgtttatcattgcagaactgcttcattcactctcgacagcattgtcacataaagcaacatttgcggtacttgcaaatataagaaaagcctgctgtgacaaactggcgcgggtgccgcttggttatgtgaaggatacatcttccggtacatttaaaaatatcatggtggaaagaatcgacagtatcgagacgacactggcacatattgtccctgaattcacgtctaatctgctggcacctgttataatcctgatctatttcttcctgacagactggagactggcattttggtcgttggtgccggttattgttggatttttatcttatttcgggatgatgttggattataagccaagtttcgagagaacggttcagacaacaaaagatctgaatgatgcggcagtggaatatatcgacggaatcgaagtaatcaaggcatttggaaagacagaaagttcttatgccaaatttacaaaggcggcttttgcatatgcggattcctttatttcctggatgaaacggtgctcgatctttcatggactgatgatggtggtcacaccttatacgcttcttacggtattgccgtttggagcacattatgtagcgaatggaacacttacagtttcggattttgtcatttgtattattttatcgcttggaatcgttggaccgttgatcacagtgggatcttatacagatgatctgggcaagatcggagtgatcgttggcgaagtggcaggaattctggaacaaccggaactggaacgtcctgagaaaagtgaacgtgttccaaaagataattctgttacgcttgaaaatgtcagatttggttatcacgataaagagattctgcatggagtaaatatggaattaaaggcaggaacggtaaatgcaatcgtaggaccttccggaagcggtaagtcgaccattgcaaaactgatcgcatctttgtgggatgtggattccggaattatcaaaatcggcggagttgatgtcaaagaactggcacttgcagattttaaccggaaaattgcatatgttgcacaggataattatctgtttaatgaaacggttcgtgaaaatatcagacagggtaacccgaaggctacagatgaacagattatcgaggtgacaaagaaaagcggatgttatgaatttatcatgcagctggaaaatggatttgatacggttgtaggaggcgcaggaggacatctgtcaggtggcgagagacagcgcatctcgattgcaagagcgatgttaaaggatgctccgatcgtgatccttgacgaggcaactgcttacacagatccggaaaacgaggcaatcctgcagaattctatcgcaaaactggtagcagggaagactctgattgtgatagcgcacaggctttctactgttaaagacagtgaccagatctttgttgtaaatgatggaaatgtagcagcacatggcacacatgaggaacttttggtgtcatgccagctttataaggaaatgtggaatgcccatatttccgtaaaagatacggtgaaggagggcgaataatatgtttgggattctggcaaaattctttcgtttttcgggcagggaaaatagtaataaatttaaactgtcgatggcgatcggactcatagaggcacttgcttcagcaatgaagattccggccattatgtacatattgatcggtttgctgagtggaaaagcgataggaaaatatattggaggctctattgcaatcatggtcattgcaatcgtagtcgatgtaatctgtaagagatactctacagtgcttcagacagaaggtggatataatgcaagtgcttttatgagaatcaagattgcagagcatctgcgctatctgccgatgggatattttaattccaatagtattggggaaatttcttctattacaaccaatacaatggaaatactaggtgatgtagctgcaagagtggtcatgctgaccatgcagggaattctggaaacatccatgattattctgatgctgtttatttttgactggagaatcggactgatcgctgcagcaggagtacttattttctttggcgtcaattctgtaatgcagaatgcagggaaaaaagattcagagcaaaaagtggtatgcgatacagagcttgtaaatcagatcatggagtatctgcagggaatatcagaagtaaaatcttacaatctgcttggaaaacaggcaaaaagattaaatgatgcaaatgaagcatgcgaaaaagtcaatacaaagatggagatgttgtttgttccctatcattttctgcaaagtgtgataacaaaaatcacaggtgcggtgatcgtagcgtgcagtgcatatttttatatcaatggaaccatgagtgcagtctatgcgatcggtatgacaatcgcagcatttatgctttatgccagtctggaatgtgcaggaaattattcatctcttttacatgtggtaagcgtatgtgtagataaagcaaatgcaatattggagctggataccatggatatcgacggtaaagaaatacagccggaaaattacgatattagactttctaatgtttcgttttcttatgacaaacggaagatcattgatgatatatcgctctctattccgcagaaaacgacgacagcaatcgttggaccatctggtggaggaaaatcaacactttgcaatctgattgccaggttctgggatgtggattccggggaagtgacacttggaggtgtgaatgtaaaagactacagcatgaacagtctgatgcgtaatttttcatttgtatttcagtcggtgtatttgttcgcagacaccattgagaataatattaaattcggacgccaggatgcaagtcatgaggaagtggtggaagcggcgaagaaagcatgttgtcatgatttcatcagcaaacttccgaatggatatgacacagtgatcggagaaggaggagccacactttccggtggtgagaaacagcgtatttcgatagccagagcgattatgaaggatgcgccaatcgtcatattggatgaagcgacggcaaatgttgatccagagaatgaaaaggagctgatggatgcagtagatgcacttacaaaggaaaaaacgattattatgattgcccacagattaaaaacggtcagacatgcagaccagattgtggttgttgacaaaggaagaattgtacagcagggaacacatgagcaactaatgaagcaggaaggcatttataagagatttgtggatgcaaggcagcaggcagtaagctggaaactggcccactgagaaataatccacagttggagaatatccaaattgaattgtctgaaagagatttaatttaagtttctctaagtttcacttgtataggtggaatgaggaaaattcaatagagcaatatgaaaaaagcactgaaaaccgttggactaatggttttcagtgcttttttctttggttaaagagaaaaaacataataaatttaagttttgctaagtttcactaagttctgcatttgcagatcgccattgtcttttcggctcatatttcccacacccatcacaggtctgtggccagttaattttccactcaaaatactcatctctggtaattttaccggatttcaattcttcttttctgagaacccattctttcataaaatcattgagaactccataattgaaccacataccaacaggtggatgagccggccagttatcagaatcatgataacggacagcggtatcctcactggaattgcatttttcacccggataggtttctaactgaaagagattaatagctgctgggttaaattcatcaatccagaataggatttctataagttcagatgcatccatagtagtcggttcgtgtagtgccagtggatttacatccagaatctgagccatttcagttacaagatctttacggggaaccctgtaatttgtttcgtattgggctaggcggtttgcacctttatcaccccaaccgagggcagcaccaagttctgcctgcgtcatatgccggaatgtccggattttttttattttatcaccgattgtcatatcagatttcctgctttctttttgataaatctattttactaccaaaaacaaggaatgtaaacagaaagattcgcattgaagcgaataaagcacttgacattcgcatgaaagcgaattaaaatggcagtataataaaggttcgcatgaaagcgaatgtgcagatgaggataaatatattttgcaaattattgcaaaattaggttggtaaaatcattctgtcaggctttattagtgagaggatttttttgaagagaacaacattttggtgtttccaggctgtaataagtgaaaggatattcaaaaaactctcttttgtaccttgaaaattacatgagctgtataatctgattccacagatgccataaccctgtaaaggattttacgggcgagcgtcaaagatactccggaaacggctggtaagtttgcgaagaagctaccagcattcagaaatattctgatagaggttggcagtaacgctgacagcagattatacgaatggaagccaacacgccgaacggaatatgcaatgctataacaatagataaactgtgagaacaaaatacgaaaaggtaaggtgatgcaattgagaaaattgcaggtataggacaactgatacaaagaatatgttggaaaagaggtgagcatcatggtgaatcagtcagtaatagattccagtgttaatctggagcagttaaaggacattgaagatttaattcctgatatggataaagctatttctgaaaaagtggaaacttttctggataaatctggcgatcagccgtatgctcacatgaatgaagggtatgtggtagtcgtggaaatgacaggagaaatggatgctacagatgcgatcagtgattatctaagaaaaagaacggagttgatgtattagatgcaagtcttgaaaaaatatcttgcgaagctacagatgttatgttaatgtgaagtcagggaaaatgaacgtgatacatggtttctgacttcaaattcaatggaataagtaagttgggagcgatgtaaaatggaacaaatgcaaatgaatatgccagatatgtacgatgctgcattgtatcttcggttatcgaaagatgatatggaagagggcggtgcgaagtcagagagcaacagcattgcaaatcagagagagttacttcggagctttgtaaaaagccagccggatattcagatttttgatatatatgtggatgacggatactcaggaggaaattttgaccgacctgagtttaaacgaatgacaactgatatagaagctggaaaagtaaactgtgtgattgtaaaagacttatccagattcggaagagagtatatagaagccgggcgatggatcgaaaagacctacccggctttaaatgtgcgttttatttcagttacagaccagttcgacagtaaaacagcagatttttcagagaagtcatttgtagttccaatcaaaaattttgtaaatgaaagctattgccgggacatttccggtaaagtgcgaagccaccagaaaatcaaacgtgaaaaaggtgaatttattggagcatttgccccgtatggttactgcaaagatccggagaataagaactgtctggtgattgattcttatgcagcagatattgtaagaaaaatattttcatggaaaattgatgggttcagtcttggagcaatcgcagaaaaactgaatgtacgtcatgtgcagtcgccaaaagaatataaaaaggcaaatggcgagaattataattctggatttcacagctcagacacaccgaaatggtcggcagtgcagatcaaaaggattctgacaaatgaagtctatattggaaacatggtacagggcaagcaggaacgaatcagctacaaggtaaaacaacgtttggataagccagaagcagagtgggtgaaagtagaaaatacgcatccggcaattatcaggcaaaatgattttgacgtagtgcagaagctgcttcaatatgatggcagagcatcaaaaacatcagacagtgcaaactttttttcgggatttgtgttttgtggagattgcaagacaccgatgatacgcagggtaaatcagtataaggggaagaaaaaagctttttatatctgccagacaaagaataaaggtggagattgtaccagacacagtattccggaagaggtgctgaaaagaattgtgttgaaagagattcaggcatatacggcactttttatagactatcagatgattatggaagaactttgtgagatgcaagtcagttacgatcaggtaattggttatgatacacagattagtaagttacaggaagaatataaccgctattacagtctgaaagcatctttgggtgatgacttgaaagagggactgatcagtaaagaggagtttgatgattttcgggaaagttacggaagaaaatgtgaagaactggagcagatgattgaaaatcagaaaaagctggtaaagcaaatgtttgagggtggagtgtctgcaactgttcagttggaggactggaagaaatcactggaaatcaaagaactggatcgcacattgctggcactgaccgtagataaaatctatatttatgaaaataagcaaattaaaattcacatccgttatcaggatatgattgagaaaatgaaagtcataagacggttttatgcggaacaccggacagagtgcaggaaagaggtgggataaatggcaaggacagcaaaaagatataagaaaaacacagagaagaaagttcttgggattccggtatgtatggctgcaatttatgccagattatccgtagacagtgatgaaaaaaagtcagaatctattgaaacacaggttacgctgataaaagaattcattcagaagcacaatgaaaatccagacagagagtatgagattgctgtatatgacatttattctgatctgggaaaaactggaacaaattttgacagaccgggatttgaacggatgatgaatgatgtcagggcaggtaaaataaactgtattctggtaaaggatttctcacgatttggaagaaattacatcgaaactggtaactatctggaaaagattcttccttttatgaaagtacggtttatttctgtatgtgacaactatgattcatttgcacctggtgctaagaatcaggaattatccatgaatatcaaaaatcttgtgaatgatgcttatgcgaaagacatttctgcaaaagaacgggctgcgaaacgtattgcacagaaaaatggtgaatatgtgggatctacagctccatacggatatcgtgtggaaaaggtaaatgggatttataagttgattgtggaaccggaatctgcaaagattgtccgtaggatttttgaagaatatgcttctggagatggtatacagagtattattgacaggctgtttgaggatggagtacatcgtatttcagactataaccaatatcatcatgtgtactgtaaggacggagaaaagcttcatcagtggggaaattcttcgatacgtgcggtgttgaaccgaaataattattatggtgatctggttcagagaaaatatgaatccagatttcaaagaggtgaaaaatggtgtgatatactggatgaaagccagtggattattacgccaaatgcccatgagccgattatcagccgagaactgtttgacaaagcacaagtcaggttaaaagcagcacaacagaaaacaacaaaaactacggcaggatgggaagaggatgaaagagcattttataatgtattctattgtggagactgcaagcggaaaatgtgtacacgcagatacagaggcaatgtgtattatttttgcaacgctgctcagtatcgggatgaaaggaaatgtagtcataaatctatctctgaagaaaaattgcagaaaattgtccgctcggagctgaccagacagtttcagttatctggcttacggaaaaaggatatgtctgctataagcagtgcggtatttctttccaaaatcaaagaagttcaaacagaaatcagaaaactggatgtagatatggaaaaacgttcagaaaaactggcacaggcatttatgcaatataaagagggggaactttccaaagaagcctatatagaaatgaaagatgaccgtaatagctggaaagagttctgcgaagagagaaagaagtctttagagcagaccatacgaaagctggaaaaacagcagaaagaagaagccagatttttacgaagcctgctggagctggatgggacaaccagaatcaatgcggaatttgcagaaggcttgattgaaagtatgtatctatatggtgatggcaaactggaaatcaacttcgggtttaagggggcggtagaacatgagtgatcagaaactgattattggatattaccgcctttccatggaagatgactcagagggagaaagtaacagcattattaatcagagaaaactggtaaaagattatatttccaatattcctgaactggtggctatgccctttcaggagttctacgacgatggatattctggttccagtatggaacgtccggcaattaagcaggttctggaacttgccagggagaataaagtgcagtgtattgtagtaaaagatttttcacgttttgccagaaactatattgagatgggaacttatctggaacagatttttccattcctgggagtacgattcatttctatctcagaccgatatgattctaaggattataagggaaagagttcggatattgaagtacagtttaaaggactgatagcagatttttatgtgaaagaccagtccgtaaaggtaaaagcggcagtcagtaccagacgaggaaaaggggagtattgctgtggctctgcaccgtatgggtatcgaatcaatcctgaaaataagaaagaactggtgattgtagaggacgaagcggaagtgattcgcagagtatttgaactgaccaatcagcgatattccaagatggagatttgtaagttattcaatgaagagggtgtattgactcccttgcagtctatgagcagacgacagaaatcagacagcaagaaagctgcatcaagaggattgcagtggacgagtgatatgatacggaagattgtggatgataagacttatataggctgtatggtctatggaaagacaaagattccagatcccggaacagggaaagaagtaccagtgccgagaaatcagtggaaagtgatggaaaaccatcacgagccgatcgtatcaaaagaggtctttgagaaagcacagtctctgcagatcagatacaccaagaaaagcaaatttgacagggaaacaacactattaggtggctatgtaaaatgcgggaattgtcgcagaagtctgacttcaagcagtcctgttcatggtcatatcctttatagctgtgcttacagtaaaggaaaagaagatacagcgtgttttgccgggaaagcggataacaaaatgctggagcatatcgtgctggcagaaataaaggcttacttacgtcagaatatcagccaagaacagatgcagcaatccatgagaaaacagcatgaggacagtatagaagcctataagacggaaagtgcagattgtgaaaagtgtcaagaacaaataaaaatccagaaccgccagaactacgagaagtatcacgagggacagatgaaccagaaccagtttatggaagccaagaagcagttggaagaagaaagagaacgactgcagaaacgtgtacaggaactggatgagttgataaacgacgagaaagaaatcctgatgaaaaagaatattccggtggagcaaatgttgaagtatttaggctatgagaagctgacacgagagatgctggaagaatatgtgcagggaatatatgtgtatgatgacgggagagtggaggtggagtggaaatcactgacttgatttgtagcaataatgtaacgtccactactactgaacttgtagcaatgacgttacatcctccctgctgattttgtgacaacaatataacgtcctctgttcccaaacaacggttttattggaaaaatcgaggaaaaaaggtcaaaaagtttgtagcaatggcttgacatcctcgggggcactgtgcctggagaatagtttcccaaagtgagaatgttgtagatataaggaaaacatgctatggtatatacagtgtgtaaagaggaacaaagaaaaaatagaaagcgtggtcaagcagaaaaaatgaagtacgaacatatcacagagggtcgtttcatagaccgtcccaatcggtttattgcacatgtggaaatcaatgggcaggtggaaacggttcatgtaaagaatacaggcaggtgcagggaatttttggtcccgggtacactaaagcttgtttttactaaatagtattctctgtaatataaaagatattgcagaatacttcttataaatgtaaaattccgcatggatttgcttttccacacaaaaagtaaaattttgacttttatagatattaatttacaattctatccactattttgaaagattccctagagtactcttgataaaatacctgcagtaaatgaacttttgcagaaaggagagcatgctttatggaacttcagaaatacgaacaggagcatctggatatacttcggccgcttcttcctgagtgtacagtacttctcaaaaagaacggcgatttcccccttggcaagccgggaaagattgcactgtatggtaacggtgtgcgtaagacggtaaaaggaggaactgggtctggagaggtgaattcccgattctttgagacagtagaggatggatttcagaaagcaggatttgaaatcgtttccagagactggcttgatgcctatgacgaaatatatgacaaagcgcaggctggtttcacagaagaaatccgaagaagggcgcaggagcatcatacacatcccgtaatcgaagggatgggagctgtcatgccggagccggaatatgatctgccactgaatgtaaaaggtgagacagccatttatgtccttgcaaggatatcaggagagggaaatgacagggaagcaagggaaggcgatattttcctgacagaaagcgagagacggacaatccttgagttgaaacggcagtacagaagatttatgctggttctgaacgtaggaggcccggtagatctttcacctgtcatggaagtggagaatatcctgattctgtcgcagcttggagtgcagacaggaagcgctcttgcggatcttgttcttgggaaaacatatccctccggcaaattgacaactacatggacaaaatggaaggattatccggattttgcgtcatttggagaacaggatgatacccggtatcaggaaggaatttatgtgggataccgctattttgacagcgtggggaaagaggtactgtttccgtttggatacggtgtgtcttatacgaattttgaagtccgttttaagggtctgaaactggatgaaatgactgcagaaataagcgcagaagtggaaaatacaggtgatttctgtgggaaagaggttgtacagttatacgtctctgcgccggaaggaaagctggatcagccttatcagactctggcttcatggaaaaagacagaagaattaaaaccgggggagaaacagacagttgaactttcattcttactgacggatctggcatcttacgacgaagaacaggcggcatggattctggaacaaggggaatatagcctccgaatgggaaacagcagcagagatacggaagtctgcggtgtcatatcagtacaggaaactttgggtataaaatcagtaaaaaactgttttggaaaaccggatttcacagactggaagccggaaagaaagagaaaggacagagtaggaaaaaagatacaatctttggaagcagatatttccagcgtggatatattgaaagtagtctatgagcataaagatgagccaatgccggagatggagggactttccgatgaggaactgattagcctgaatgtgggtgctttcgttgcaggaggagtgacaggcatcatcgggaatgcttctatgtcggttgcaggcgcggcaggcgagacggcaaaagtgggagaaatccccgtgatcgttatggcagacggaccggcaggactgcggctttctcaaaagtgcttccgggatgagaatggaatacatagtctggggagtacaatgccggagacaatgcagaatcttctgaccgaggatgagcgcgcatatatgaacagcatgattccgcagcccggagaggacagtgagatctttgagcagtatgcgacggcaattcccatcggtaccgcgatcgcccaaagctggaatccattgcttgcagaacgctgcggggatatcgtaggaagcgaaatggagcggtttggcattcatctgtggctggctccagctcttaacatccatcgatccatacgatgcggcaggaattatgaatatttttcagaagacccgctgataagcggcgtattcgcggcagcacttacgaaaggggtgcagagccatcccggatgtggggttaccatcaagcattttgcggcgaataatcaggagacaaaccggtataacaataacagtatagtcagtgaacgtgcgctgagggaaatctatctaaaagggtttgaaatctgtgttcgtctggcacagcctaaagccctgatgacatcttataatctgttaaacgggaagcatacatctgagcatagagaacttcttgaggatgtgctccgctgtgaatttgaatttgacggcattgtaatgacagactgggtaacatcctctgatatattaagtgctgatgcgaaatatcctgcacccgaggcatacaaggtggctctcgcaggaaataatctttttatgccgggaagccagcaggaaattgataaccttacggcagctctcaagaacggtcatattacaagagaggaattgataaaaaatgccacccggatctgccggatggctgtggaactcgcaggcgcttcagtttgaccggccttttgtctgtttccggtactggagcggtgtgataccgtattgctttttgaatacattctgaaaataggactggctggaaaagcagagatagctgctgatttcagccagacttttttcgctgtaggtcagaagactttttgcttcttccagcttgcagcgcataatgtaagcgcccatccggatgccgagttcacctttaaagtgtttcatcatataagaggcactgcgccctgtatgagcggcggcagcttctacagagataggctcatttgtgtggttccggatataggtcatacattgatagacatccggggagataccttccgggatacgtgtttctccggcacgctgacagaaatccagaagcatgacatactggagctgattgattttctcaattgtgcgcagctgttcacactcttgaatgtaatagtctatgagctggtatgttttttcgatatccacaccgcccgggattgcacccatgataccggcttttactacagcgctgataaagaggtttttggcatgccgcaagggtgcgcctgccatcttcccttccttgaggggagcacgggtggcagagagaaatttcttcagggcgtctgtattcccattcttgattatctgatacaattccagttcaaaatagtaggtgttatgaacatttccttcttccttatcttctaccatttgatccgtctgttggttaaagcgctccagtgtgagcttgtcattttccagaaagagctgttctgcggggacagtcttgtggttgatgcactgatggagaaataccagataattggcaaactgtgcctgaccaagcagggggattgcatagagcaattctgcgtactgttccctgttctctaaagagactccactctctctggaggaatagcgaattagttcttcggtgacaggaacgttgaataccgggccgagaatcagattatagttggtattctcgattaaaaggcgtccgtagccgatatccggagaatcactgcaaaaggtcggattatgatcgctcatgggaaagagatcctcacggtagtatgcaggagatgtgccggtgatatcattaaaagaagtatagactgcatatttgcctttcagtaatgtgaccgggatttttgtcgccgcataaaaattcttacacatagatagataatctgtttccataggtcattctctccttaaactaaaattatatattctattttacaataattaaaagaatattacaatatttataaattgccatgtgatagtctgacatcagaaaggttgctgtgcaagaaaaatgataaggtagcaggagctggaagagataggaggaagatcagaatgaaacaacgaatcaggatacacaaggcagaaccgaatacgggagtcctcaattactctcatctgctggatgcgcctgcgggaaaacatgggtttgtcgaagcgaaaaaggggcatctttattttgaagatggtacgagagcgcggtttttaggattcaatgtggcggcgcgttccaatacgccggatcatgagacggcggacagaatggcggaacggttcgccagcatgggagtgaacatcatccgtctccatgcggcggacgcccctgtgggagaggagccgggaagctggagcagctgcaaggaagcacctcttctggactatgcatccggtaccagcaggaaattcaacccggatgggttggaccggttcgattactttgcggcgaagctgaaagagaagggcatctatctccatatagacctgattgtagcgagaaagtttgaagagggagacggcatggagtatccgggcggtgcaccctcctgtatcaaacggtactgtctgtacaaccagcggatgattgaactccagaaagagtatgcaaaggagctactctgccatgtgaatccctatacgggactggcgcttatcgatgatccggcggtagtgacaatccaaatcaacaacgaggacactgctatcaaggggaatatgggcgacgatgcaggggaagagatgaaatcctaccgggcagaagtacaggagcgctttaacgacttcctgctgatgaagtaccacacacgggagcatctggaagaagcgtggacaaaggacggttgctgcgcactgggggaggaagaagatccggctcggggaaccgtccgggggattgaaggcagtttctaccagccggtcagcgacccggaaggagagtgggatgcaccggaaggaccggcaagatatgccgactttatggagttcggcatctatatgaaccggaagttctatcaggatatgaaagactatatccatttcctcggggcaaaagttcctgtcgttaccagcaatttaattgccggggcagcggatgtgtatgggcatacagacggcgacctgatggagaataacagctattttaaccatcctctccttccggtagagaataatacatacctggtggccggccccatggaatatgtctctacgaatcctctgaccatgcagaccggcgcgggatcagcggcaacaacccttttaagtctgggatcactggcgattgtgaaaggaaaaccttttatgctcagcgagtggaacgagtatggggagcatcctttccattccacggcgtttgtgcagatggcagcatatgcctgcttaaacgactgggacggactgattctttataatcaccatacctccgagaactgggatgaccagccggcagatgagatactgaatgttttcgatgtatataacgatccggcagtaatctgtcagtggggattcatggcctctgttttcctgaaggggcttgtatccgtggcaaagaactgcgtggatgtggtctacacacagaatgacctgaaaacgctgcctcttttccacgctatgccgactacatttttcccgtatatcacgtccatgcgcaatgtatttctggacggaggagacaagtatcagggcaatgcggacatagcggtaaatgccgggttcttaaacggagctgatctctcagatgcggaacatggagtatattatgcatggtctgagtacagggatgcgttccggtgttataaagaagaaaaccgtctggaaaatgctgcgaaagacacgaaagagattcagccgggagtgcatcttggagaaaaagcacttgtgttcgaccggatcagagagacatcgggcaacggagattaccggacgtttgccgaaatcatggacagtgcgatgaaagagtggggtattctgccggaagataccggctatgtggaaggaaggctgatttcagacacaaaagaaatcgtttttgacccggatcacgcacgcttctctatccacacaccttactgcggctatttcagcggcgcgccggaagaagagatttccctttctgacaagatctgtgtggaggcggaaaacgaaaggattacactggctctgatcgcaaaagatgaaattaagatggatggcgcgtcagaatatattttgacggcaatggggacaaccggtatggacgagacaacatttggcaaaggaccggagctgatggggattccgtttgccgctgtggagttcaaaggcaaactgtacgcagagacactggaaggctgcatccgtgtgaaagcggagaatgcgaaactggaggtgttaaatccgatcggggaagtaattgccgaaatgaatggagaaaaaacaggagatgaaatacggtttgcaatggacggttctgttccgggcatccagtacagacttgtggtcggtgaataagcatagtttccaagggagtgctttgagattacaaaataataaaacaggagattgaaagaaagatgaattctgagttaaagaaaagtgcacaaaatggattgtatgagttcgcaccggacgggaacggctgccggatctatcatgcggaaacaccgcgttattggtataattacctgtggaatgaagaccgctactgcgctcagatatcacaggtaggacacgggcgcagttattatctgagcgaaaaagcagatatgtgtatgatcaaccgggatgatgccagatacgtatatttaagagatgatgcagacggaacatgctggaatatcgggaaggggtcgcttaacacagaggtggaagactactgctgtacacatagtatcgggcacacacagatttgctcaaggaaaaacggaatcgaggaatcctggaggattttcgtgcccaagaaagggtttcatgaggtgtggacactgaaacttcgcaatacagcagagcaagagaaaaggttaagcatgttctctgcggtcagtttctatctggaaggcttctcttatcccagatactacgaaatgtaccgctgcatgaagacagaattcaaacgggaactgaacggaatctactgtgattccgaccatcccttcgcaccccatgaactgtatcatgggtttctggcttcatccgagccggtttatgcatgggacggtgacctgacgaagttctgcggttccataagtacactgacacttccggatgcatcgacctgcgccctgttccagagaccagatattgtcgtgaatggaaaagactgtacaaattccgaagcctcgctgttcattcttggcggggtgctgcagcataagatcacgctgatgccgggagaggagaaagagattcaggtggtattcgggatcagctcttcctgtgaagaggcatgcagtgcagtaaagcggtatgcagatgcagaatccacagaacgggagttcgcagaggcggaggcgtataactatgagaagattagctctttgtctgtgaaaacaccggaccagaagattaatcatatgatgaacaactgggtaaaaaagcaggcagatttctgtatcgtaggaaagaaaggtgtccgtgacaacctgcagatttctgtagcgctgttgaattaccgtcaggagaaagcaaaagaagaaatcctggaatgtctgcgccatcagtttcaggacgggcacggagtgcttacatggtatccctatgatgatacgcgttattcagaccaaccattctggatcatctgggcggtgtgcgaactgctcaaggagacgggagatctgtcaattcttgatacggagattgaatggcaggacggcggcaaagcatccgtgctggaacatgtaaaggctgcgattaatcgcttaattcttgataaaggggagcatggtttggtgaagatttatttcgccgactggaatgacgccttaaatattacggatgatccggaggcagagtctgtgatgctgtcccaccagttctgtctggctctgagagaattaaagagaatgatggagtatgcgggtgatacacaatatgccggatttctggagaaggaatatgaacagctgaaggaagatatcaaccgctatgcatgggatggaaaatggtatgcgagggccttaagcagcaagggaaacgtaggaacgcaggacagcgccggaagcaaaatctatttgaacgcacaaacatgggctgtactggcaggagtcgcggacagagaaaggctggcctacgtgttggaagctgtggacagtatggagcaggattttggcttcccattaaatctgccgccgtacccggagtatgatgcccatgtgggaaggatgtccggtatgctgccgggactttttgagaacggtggagtgtactgtcatgctactggctttaagatcctcatggactgctgtacaggcagaggggaaaaggcactgaaaacgctgaaaaagattatgcctgacagcaaagagaacccgtcggcgaagtccggggcagaaccttatgtatttaccaactgctattccacgaacccgggatattacgggaaatcctatcagtcatggacaacaggaacttccgcatggtgcatgatggggctgtatgaaggtattctgggtgtgaaacgggattatgaagggcttaggatcagtccctgctttcctgaagaatgggaagaggcagaagtgacgagatacttcagaggtgcggattatcatattatcatccgcaatcccgaacatattaagaatggaaaagccgaggtttatgctgacggttcaatctgcgattccgggctgataccagactatcaggatgctaagcagcataggatagaagttttaataaaacgaggatgaaacttacaattttgtaaattattttacaataatcatctatagaaaaacagtatagtaaacctatcatcaatgatacaggaggagaggaaagatggcaaaagacaaaaacgcaccccgttacgacaagcagggcgcaaggcgcgtaatgcgcaaaagagattatctggcagatttcggcggacagctcgcattagggctgatggcgaatctggtcggacagctcaattatttctacacggacaaggtaggactggctgtcggaagtgttggtattgtattggcaatctcaaaggtgattgatgcattctcggatgtgattgcggggaattttatcgatcattagagatgagcaaaacacattaattcaaaagtaggacgtggcagttagtttccataaagtttgaagttacgattttattgtcccgtcgctgtctgtttcagcgattgtctttgtaacccatgtacgagtagcttcggcagggagattgtctttattatagaagcctgcataatacttccatgtaaattccgcacctgctagagaagcgttcccttgcggattgtctttctgtgtttccatatcaatcttgaaaagctcaatcaaagtgtccgttacttttggtgtatctgatacattcaaagttgctgtttcgccagctttgattgttaatggatagatttttttatccactttatatcctgctggtgcggataattccttgatatagactgtgcctgcttttacctctacaacatctgtatttccgttttcatcagtcgtaagggtggcaagctgttttgtgcagtccttatcaacaaagacaccatatgtcgcaccagcgacagagtaattcccgttaccgtcggtaatactggtattactggaagtcttttgcagttttgcatttccgacattcagcttcgcccagaattgtcctaattcctgcccctcgccagagtagatataaccgccacattcatagcgtcctttattttctttgacaaaggcttttgcaccagagaaaacttcgtcctgcgttgcctttggaatttcatcataagaagctcgcacgttatcacattgccagccaagatgtacgctcaatctctgccagactacacattgttccaacagatagacttgtttatagttcaattccttgtgagcttcgccatactgtttgacatactctaaggacaacgccacatctgaaatctggtcggcactcatgcgtgagcttgcgtcagctctggtcttgtagccgttcttaaaatctgtattgatgtcaatacaataggcagtttcgccctcgactttcatatagccctcgttgaatgtcgaaccgatagaaccgtcattcattactttttcaatgataccgacacgctctgcactttccgtccagtattgcttactttctgcatggacgggtgtagtcggtaaagcagtaacgacagttgcaagagctaagaagcccgtacacaatcgtttccatgtctttttcataaatctaatgctcctttcattttgagtaataaaatagccgtccaataagaacggctggaaatagaaaaggaacgtcattttaggcgttccatagtctataaaatattcaatttttttcttgtttcaatactgatgtgctgtaccatatctttgcatatctaggaaaactggcgtatcaaggctcattcaatggtagtaaataagtagtaaattgatgtatttgttcccttgaaaatgctgatagatactgtgttttagcggataatcagatttttattgtgtttttaagcataaattcctcttgtatattttcaagttctgtattagaataaagttatgcgaaaggcatatcgattttaactttttcataataataaggaggatacatatcatggcacacgtaatttcagacgaatgtgtaagctgcggagcttgcgaaagcgaatgtccagtaggagcaatctctatgggtgcagatcatatgcagatcgatgcttctgcatgtgttgactgtggcgcttgcgaatcagcatgtcctacaggagcaatcagcgctgagtaatcagaacacgtagattgaataagacagtaagaaagagacgattttcatctgaagatcgtctctttttatgtatacgtctgaaccaaatacagatccagtaagcatcatcctatctgacattcttccctctgcaacatttgtcgaacgatttttctttccatctcttcttcttatgctacaatagacttgtactcaatctatatcacatacttattttaataagggggttatcgtatgggcgacgttcattacatgatctcagaagctgccaaacacgttggcgtagaatcacatgttcttcgctactgggaggaagagcttgatcttccgatcggacgcactgagatgggacatcggcactatacggaagaagatatacagctttttagctgtatcaaagaactcaaagaacagggactactcctgaaggagatcaaacagctccttccggacatgcttcgcacaaaagcacttctgaaggccagaaaatcggacgcaccaaaggctgccgcttcgataaacgaagttgctgacccccaggatccggctctttctgtttatacagcagacaacctttctctttctgtttatcagcctctgctcgaagagtctctccgaaaaattcttttggaaaacaaccagatcctggaggggtctctcggcaaatccgtatctgaaaaagtaacaaaggaaatggattttcttttacaggcaaaagaacgcctggaagaagaccgttaccggaagcttgatcatttacttcgtcagcagcaggcgctccggaaagaagcttcaaaatctgccgccggacattacctgcggaaattatttggcgaaaccacataaaagtcaaaagacagcgaacagttttgattctgttccctgtctttttcatttcataatttctcattccccatccacaacttttcgttctgaattggcaaatttcgtgtactgcggaagccatgtaagcgttacggttccaatcggaccgtttctctgtttggcaataatgatctctgcctcattgacatgctccgtatccttattataataatcatctcgataaatgaacataaccacgtcggcatcctgctcgattgctccggactcacgcagatcagaaagcatcggtctgtgatctggtctctgctcaaccgcacggctcagctgtgacaacgcaatgaccggcacacttaattctcgggcaagcgcttttaaggaacgggaaatatcggaaatttcctgttgacgggactcattacgtccaccaacacttccgctcatcaactgcaggtagtcgatgatgatcagctcaagattatgttccattttatattttctgcatttggaacgcatttccgaaatcgaaatacccggtgtatcatcaatgatcaggttcgatcttccaattgttccggcaccttcgatcagcttttcccagtcagaatccttcagattaccgtttcttaaaagctgtgcatctacataggattccagcgagaacagacggtttaccagctgttcctttgacatttccagactgaatatggcaactgtacggttctgtttaaacgccacatgctgtgcaatgttcagtacaaacgccgtcttccccatagaaggacgggctgcgaccaggatcagatcggagggctgcagaccggatgtcttgtaatccaggtcaataaatccagtcggaattcctgtaacagttcccttactcttagatgctttctcaattttctcaagggcatttaacactacctgcttgatcggcacgtattcaccgtttcctccgcggttctgcaccagctcaaaaacctgcttctctgtcctttcaaggatcgcctccagcggctcctgtccctgataacattcatccgcaatcgcttcattcatcttgatcagacgcctcaacgttgctttttcagagacgatctcagcataatactttacatttgccgaggttggaactgctgttaccagatcccggacaaattcaagactactgatctcttccggaacagctttttcacgcagacggttctgcagtgtaatcaggtcaacgggttttccctcattaaaaagttctaccactgaatcgaaaattacaccatatgccttttgataaaagtcgtctccacaaacgatctcggcagctactgtaatcgcatcccggtccatcagtatcgctccaacaacagactgctctgcctctatgctgtgtggcggtactctcttaatgagtgcttcatccatgtctcagatcctcctaagcttccccaacgtgcacttttaattcagcagtcactttctggtgaagtttgaccggtacaagatgcattccaggtgtacggatcgcttctttgatctggatctttttcttatcaagatcatatccaagctgttcttttactgcaattgcaatttcctttgaagacacagaaccgaatgttcttccaccttcccctgtcttgatcttgagttctacttttgctgcctctaatttctttgcaagttcctgcgctgcttccagatgctcctgtgcaaccttttcttcattctgtttctgaagctttaagtcatttaaattctttccatttgcttccagtccaaggttttttttgaaaatgaagtttcttgcatatccgtcacttacatttacaacctcgccttttttcccaagggattttacatcttccaataaaataactttcatcttaaatatctccttcttctatcataatatcgattgtctttttcagagtttcaatcgctctttccatatcggaatatggaaactgggcaccggcagtgttgatatgaccgcctccgccgagccgctccataatgatctgtacattgatctcatcaatggaacgtgcactgatgtaaatcttaccattatattcagtcagtacaaaagaagccttgatttcctcaatattgagaagctcatttgacgcctgtgctccgataatagtgggactttcaattcccagatgttcgcctcgtgcgatcgcaaatacatcccgatatacctcagcactgctgattactgcagcttttgcccggtaagatgccatatcatcacggaggagttttcttacataagtaacatctgcgccacatcttctcaggtacgcagctgcttcaaaggtccggactcctgttctggacatgaaattgttggtatcaaccagaatacctgcatacatactgttcgcttccatggaatttaaacgcagatcatcgccgatatactgaagaacctctgctaccatctcacacgccgaggaagcatatggctcaatatacgacagaaccgcattctcaatcacttcatcgctctgtctgtggtgatccagaactgcaatcgtcttcgtcagacgaagcaggcgttcacattctgtcatctttggcttattggtgtcaacaacaactaccattgtattgtcatctgccagttcctccgcctcatgggaagtcacaaacagatcatccggatacttcggatcatcagtaaatgcttcataaagcggtctgagtgtcacagaaatatcgttcaggacaatattgactttctttttcatcgcacttgctgcccggtaaataccgattgccgcaccaaatgaatccacatctgccatcttatgtcccattacgatcacacgctcttttccggtgataaactcccggagtgcttctgcttttactcttgcttttacccgggtattcttagcagtctgctcacgctttccgccataatagctgattcccttgttattcttcacaactacctgatctccgcctcttgcaagtgcaagatcgatcgctatacgggcataattatatcctgcagcataggtatctgtactgagtccaagcccaatacttagtgtaaccggaatctgattgccgatactgactccttttacctcatcaagtaaagaaaaacggtctttttccattcgattgaagctttcttttttaattacaacaaaatatttgtctttctcaagcttcttcacaataccggaaaaatccgcaatatactggttgatcttacggtcgatcagtgccaccagaagagactgccttacttcctcgacactttccatgacctcttcatagttatcaatataaaccagtccggccaccagccgctgctcttcattcgcccggatataccggttcagctctgtcacatcctgaagatgtatcgcaataaaatattccttttcctccggtatctccagaagctgctctgtctcactgaaaccttcaaccgatacgcactggatctcagcctgataatctctgtcaagataattgaattccaggcttaccgattcattctcttcctttggaaatacgccccggttcaactccggaatatatttactcagataggtatccttccggatagtcgtcccaaggacttcccggaactgtgtattcgtccagatgatttttccatcatccagtaaaatcgcatacggaatcgaaagttccttcagaagtgtattctggacaatcccgtactgcgctgcaaactctaccatgtctgccagaatcagagacttgttgtaaaaatacataataccaatgacgactgcataaaccagcacaaacgcactcataagcagcccggcctttcgatccatcctgaagatccagatattcatcaggataaggaaaagaatcataattcccggccattgcatatacaatttcagttgtccctttaactttatatcctttttcatctttcagccctcttaaaacctatagatatttgtattatatcacctttccggatattagggaactaaaaaatgtgccagggaagtgttcgccccgacacatttttctttcttttattaagcttcgtatccattcggattcattgtctgccatctccatgaatcctcacacatcttgtcgattccgcgttctgcaacccatccgagctcgttctttgctttttctgcattacagtagcatgttgcgatatctccggctcttcttggcttgatctggtaagggatctcttttccacatgctttttcaaatgcatgcaatacatccagtactgaatatcccactccggttccaagattataaatgcttacgcctgatttttcctggatcttcttcagcgcctttacgtgtccaattgcaaggtcaaccacatggatgtagtctctcacacctgttccgtccggtgtatcataatcatcaccaaatacccccaggcattccagcttaccgattgcaacctgtgcaatatatggaagcaggttgttcgggatacccttcggatcttctcccatcagtccgctctcatgtgcgccgatcggattgaagtaacgaagaaggacaacattccactccggatctgccttatgcaggtctgtcaggatctgctcaagcatccattttgtccatccataaggattcgtacaggttcccttcgggcattcttctgtaatcgggataaatgccggatcaccatataccgttgctgaagaactgaagatgatgttcttcacattatggttacgcataacatcacaaagtgtaagtgtacctgcaatattgttctgataatattcaagtggctttgcaacagattctccgactgctttaagtcctgcgaaatgaatgacacattctacactttctttgtcaaaaatctgatccagtgcttctttatctctgatatctgctttataaaatgtaacgttcttaccggtgatcttctctacacgtctgattgcttcttcagaagcattgcaaagattatctactacaataacttcatatcctgcattcagcatctctacacatgtgtgactgccgataaatccggctccgcctgttactaaaattgccatgattttttcctcctgaaattagaatcatttacttttctttacacactatagcacacatcctgcctatatggaagtgtttttactaaattatttatattttttagtaaatcaaatgaactatttactaaattttaacacattcctactcttcccagagattttccggataaagaccttcttttttcagattgcggattgcttctacgacaaccggtttgtcttctttataagttacgccgtaccatttgtcttccgacggaagaaccgctgctgttgcacggtctgcctccagaagattgcttacgactgccggcaggaaatattcacacttcatcggattttcagtaagtcctttcttcaggaactgtggaaattctgctttcagctcgtccagtatgcttctcgtaaatccccacatattcatggaaaccagtgtatcctctggtaaattttcccaggtttccccatcattttcagtaaacgcaatcttaccgtcacgcttttcaatgcgggttctttcggtaatatttaccagttccccttcttcattggtcgtacagattcctcttgccacatgaccattgtctgttactgtattcttcagaagatatccgaccatcgcataacgatacttatcatcatcctcatgctcagacagataattataaattgcttcaaacgcatgtcttccataataatcatctgcattgataacagcaaatggcccgtcgatctcatcaatgcagctgaggactgcatgtccggttccccacggtttcactctgccttccggaacttcaaaaccttccggaatgttgttgatatcctgaaatacataagaaacctccatatattttgccatacggtttcctactgcttctctgaaactgtcttcattttctttctttataataaaaataaccttctcaaatccggctctttttgcatcaaacagggaaaaatccataatgatgtgtccctctttatcaactggatcgatctgtttaagtccgccataacggcttcccattcctgctgccataattactaaaactggttttttcataattgattctccaattcttttttagatttcacaactttctctttcttattctaaccccaaatgactcctttttcaatcgtctgccagacagaaaaacagtaaaaaaacaggacttccaaaacggaaatcctgttctgatcatattcgattaatcctgaacgtatggcattaaagcgatatgtcttgctctcttgattgctactgtaagagctctctgatgttttgcacagtttcctgtgattcttctcggaaggatttttcctctctcagaaacatatttctttaattttgctgtatctttgtaatcgatttcgttgttttctttaccacagaatacacaaactttttttcttctgcgtccgcctcttctcttcattggagagtccggtctgtttcctttttcgaatgccattgtacacatctcctttcaaccttaattaaacggtaactcctcatcaattccatctggaatgttcatgaaaccgtcacctgcatcagcgcttggcgccggtgccggggctgcctgataagactgtgtattagcactgctagcattcttactttctgcgaattcctgttcctcaacaacaacttctgttgtatagacctttacaccatccctgttggtatagcttccggtctggattcttccgcaaaccactacacgcattccctgacggaaataacgttctgtaaattcagcactctttccgaacacaacacagttaataaaatctgcggtctgttctccgtcacgcttgaatctgcggtctacagctaatgtatatcttgcaatagcgagagcgttctcaccttgtgaatatctcacttcaggatctcttgtcagacgtcccattaaaactactttattcatacgttgcctctttctaagcttcctgtttcacgcataaatatctgattacaccatccatgatacgaattctttcttcgatttcgcctggtgttgttgtttcagattcaaagtgaatgaagtagtagtaagcttctttcatcttctggatttcgtaagctaatctcttctttccccattcgtcaacgtcagtaatgttaccaccgaaacgtgtaacaagtgctttcaccttttcgattacttctgctctggcgtcgtcttcgagttttgcgctgacaacaactgctaattcatatttgctcatgtcctgcacctccttatggtcttttggctcccggatccgccgggaacaaggataaataatatatcacaagttggtatgatatcataattcaggctttgtttcaagccttttttcttatttcttttgtatttttttcaaccagtctgcgcggtaccattacctggtgtccgcatccctgacatttcagacgaaaatccgcccctactctcaggatctcccactctgagcttccgcacggatgcggttttttcatccggatcacatctccgacttcaaattttgcttctgctgccatcgctttactcctcttttattctcctgccggctgtacatttaccctgacaccgtgtacgatcgttctgtcatcatttccctcccgtgtacaggtggacaacgtcacgatctgcgaatcatttcccacttccacacctgtatcatacaaagaagacgccttcgttgcttcaaggaaggatgcaaacgccgcatcatctgcgaactgatatgtatagccttcggaagtatcttttaccactccaacagaataaatctgataagtagccacattgccatccggtgtataaatatagaaggaagggtatttttcccagaaacttttttcgtgatactgctccagctcattaaacatcgttccattatacatataatgtccgtaaatgatcgtgtttctgtcattaaaatccgcatgattataagcatttacaaaaatcgttcctacggtattgtcatatcctttgaatgtcttactcagatattctgaattatcacttccttgcacaaccggataattgatcaccgccggttcatcaaaacggatccatgcaaccacatccggattgatctgtctgagtgcatcaaaatccacggaaaatctgcttccatcctgatcgtccgtcccgttctcctgttcccccttatcttccgtaaccgcaagctttaccagatcatcatactcactttcccctttgtgatatccgttaaagattttatacagctgaaaggcagaaaatgcaaacacacagattgcaacgatcaaaatgaccgtactgatgattccaccttttttcttgcgccggtcacgcctggaatgctttccataccgaccatgtcctttccgtcccataatttcctcctctgctttttatatatgatgttcccagattgctccattgccatgcaatctcagaagtcctattttcttccatattttcacgatatcagcagtataacatactttttagagttttttaatagagagtttattgatttttttgtgtgcaggcgtacaatgtaaaccatcgtatagtatcatatgatgttgtggtcaaaaggtattttgacccctttgataccagattgctacgtgctttgcactctcgcaatcctcaaaaacattcgtaatctgctcatttctctttgaaaaatggctacttactcatgtttttgaccttttgcccctggtatcatcatattctataaatgaaaaagattgggtgaacattatgaaagaaaaactgatgcgttttatgtatggaaggtacggagtagataccttcggcaaatttctcttatggagcggcgtaattctgatgctgatcacaagcatcttccattttcgtattttttatgtaattgggtgggcattcgtgatatactcttactatcgcatgttttcacgtcagacctacaagcgtgcactggaaaaccagaaatttctccagcacacttcaaagatccgtggattttttgcaaaacagaagtatatggcagcgcagcgcaagacacaccacatttacaagtgtccaaactgcaagcagaagatccgtgtcccaaagggaaaaggtaaaattgagatccgctgtccaaaatgccagactacttttatcaaaaaaagctaacgatcaggagaataatcaattatgcaggatccttactcaatactcggcgtttcacgggatgcttccgacgaggatatcaagaaagcctaccgcaaattaagccgtatttatcatccggatgccaatatcaacaatccaaataaagatcaggcagaagccaaattcaaagaaatccaacaggcttaccagcagattatgaaagaaaaagaaatgggtgcctccggatataccggaacaggctccggaggttttggcgatgccggaagcggatacggaggttttggcggttttggtccattcggcggtttctacggtcagtataccaatcagaatcagcagacaaccgagacagaagaagatattcatctgcgtgccgccgccaattatctgaacagtggccattataaagaagctttaaatgtcctttcaggaatcaaagaccgttctgccagatggtactattacagctctatcgccaattccggcatgggcaataatgtcctcgccctggagcacgccaaagaagcacttcgcctggagccgtccaactatcaatatcagtctcttgtcagccgtcttgaaaatggtggaagctggtatcgtacacaacagacaatgtatggcggtacaccaacgatcaacaatgatttctgcgtgaagctctgcattgccaacatcatgtgcaatctctgctgtggcggcggtggattcttctgcggttctccttatacataccactaaatgacaggaggaaatactatatgttagattatcttgttgtctatgacagtgagacaggaaatacaaaaaaaatagcaacagaaatttttgcatcccttccggggatgtccaaagatctgataaatcttcatgaacgtaccgatttcccagaagccaaaatttattttgttggtttctgtgttcaccgcggaacctgtcgcctcgagattggcaacttcctttccggtctgtcgggcaaatccgttgctctctttggaacctgcggtgccggaaacagcccggaatactacaaagagatcgcatccagcgtccggatctggcttgaagatgacaaccactatctcggttcttttatctgccaggggaaaatgccgcttgctgtccgtcaaaaatatgaatccttgctgaacacaccaaaagattgcgattgccagcaaatccgacggcaattacagaattttgacgaagcaatgattcatccgacacgcacagaccttgaaaatgcgactctttttgctaccgaatgtatagaaaaagttaagtccgtgtaaaaaaagtgtaaaaaaatatcgtttcagtctacctatggaaactttcttgttatataataagggtgtcgtatagcgtcactttgtgtgatctgcatgcagacttttcatatttaaagtagctgtacgatattttttttgcgacaaaatgtaaactaatgcttaaagaaaaggaaaacaaaattatgggaattacaatggttttgtcattgctcagtggggtagccctgtttttatacggtatgtcactgatgggcgacagtctgaagaaagttgccggcaataagcttgaacttattttatacaggctgaccaatactcctctgaaaggacttctgctcggtactgtcgtaaccgctatcattcagtcatcctctgcaacgacagttatggtagtcggatttgtaaactctggtatgatgaaggtcgcacaggcaattggtatcattatgggtgccaacatcggaaccagtatcaccggatggatcctatgtctctcctacattgatggttccagcggaatcgcgcagcttttatcaaccgctacaatttctgcaatcgtagcaatcatcggaattattttccgtacatttatcaagaaaaaaccatattctgatatcggtgacatcatgcttggctttgcgatcctgatgatcggaatgcagaccatgagcggtgctgtctctccgctgaaagagaatccgcatttcgtcagacttctgaccatgttcacgaatccatttatgggaatccttgtcgggatcgtatttacagcagttttgcagagtgcttctgcttctgtaggtatcctccaggcactgtccattaccggatcgatcacctttgcagctgcacttccgatcacaatgggtatcggcgttggcgccgcatgtccggttcttctttcctcaatcggaacgaacaagaacggaaagcgtactgctctgatctatctgctgaacgatttatttggtatgattttctggtccatcgtattctattctgtaaatgccatcgtgcatttcccatttatgggtgaaattatgtcacctttccgtgtggcacttttgaatacggtattccggcttctgacgatccttgttcttgctccatttatcggcaagattgaaaagcttgtcttcttccttattaaagataccgatgaagacaacgaagagcaggcagatttcgatcttcttgaggaacgtttcctcaattatccgccactggcaatcacacagagccagcttgcagtcaacggaatggcaaagaaagcatacaaaaatatccgtcgcgcccttgcactgctgaaagatttttcagataataagttcaacaaaattcaggaaaaggaaaatctgatcgacaaatacgaagataaactgggaacctatctgatgcagctcaatatgcatgacctgacaccggagcagtccaaacagaccgccaagttccttcatacgatcagtgattttgaacgtctgggtgaccatgcagtcaatatttcccgtgttgcacaggaacttcatgaaaaatcacgtattttttcagatgcagccaaatacgagcttcatgttcttgaatccgcattaaaagagctccttgatctcacgatcaattcatttgtagatgaagaccttgtaaatgctgccaaagtagaaccgcttcgcgaactgatcggtattttatgcaacgatttgaaaatgcgtcatattaaaaggctccgtaacgggcagtgtgatctgaacaccggatttgcatttaacgatctgctcaccaactatgatcgtattgcagcccactgttctaacattgccgttgcaatcctggaactggattcttccaatttcgatatgcacgaatacactaagagtgtacggaaattgaaagacaacaattatgtatccacctttgattattacgagcagaaatataatatcaacgaatatcagccggaagcggaacaggatacaaaagcagccgcaaaaaacccggtcaaagctgttgaagccaaaaaataatcttacaatgagaaaggaatctgctgtaatgtcttctttaaatatttcatcacaggcacacattgccagtcagtccgtcatcctaggtgatgtcaccatcggtgatgactcaagtgtgttctattatgccgttgtccgcggtgatgaatcgtctatcacgattggcaggcgcagtaatatccaggataacagcaccgtccatgtagattacggttttccgaccgttatcggtgatgatgtcactattggtcacaactgtgtaatccacggctgtacaattggtgacgcgtctctaatcgggatgggaagtacgattttaaacggtgcaaagattggaaagcattgcctgatcggtgccggaagtctggttactcagaacacagttattccggatggaatgctggttatcggaagcccggcaaaagtaaaaagacctcttaccgaggaagagatccagtcaatttataaaaatgctgcggattatgttgcattatcggctgcgcagtttgaatagaatatcaaatctgaaatatgtacattattaaaaaaagtatcgaaaatcatttatgtttgattttcgataccttttttatctactacaacactttatttttcatccacgatctggaacacatagaatttaagataatacgattcttctgccgaccacagaatcggatgatctggcgcctgtgtccggtattctacctgtctgactctcttatgcacattctgcgctgcctggtggatcgtcttcgtaaaaagctcataatccataaaatgcgagcaggaacaggttgccagatatccgcctggttttaccagcttcattccgcgcatattgatctcacgatatccctttgtcgcattcttgatcgtcttacgggatttggtaaatgcaggtggatccaggattaccacatcatactgctttccttcttcttccagctttggaagcaggtcaaatacatctgcacagataaattcaactctatcctctaatccattgagtcttgcgttctctcttgcctgttctatgccaagttctgaagcatctacacctgtcacatgctttgcccctgcaatccctgcattcagcgcaaaagagcctgtgtgcgtgaagcagtccagcacctctgcatccttgcaaagtctctggattgccagacgattatatttctgatccaggaaaaatcctgtcttctgtccgtctttgacatcaaccatatatctgacaccattttccacaatctcaactttggtatcaaattcttcaccgataaagcctttgactctctccatgccttcattctgacgaacctttgcatcgcttcgttcatacacgccacggatcgtaattccatcttctgaaagtaccgctttcagaatgtccacgatttcttctttcatccggtcaattccgagtgcaagagactctacaaccaacacatctgagaatttatcgatcaccagtccgggaagaaaatccgcttccccgaaaatcacacggcagcttgatgtatctactgtctttttccggtattcccacgcatctctcacccgcatttccagaaatgcatgatcgatctcctgatcctgctttcttgtcatcatacggatccggatcttagaattcatattgataaatcctcttcccattccgtacccgtcaaaatcatggacgatcacaatatcaccattctcaaattctcccataatcgaatcaatttcattatcgaatatccaggcgccacctgatttcagcagacgtccctcaccctttttcaatgtcactatagcctgacgcatcttttctccttccacatactcttacgtattcttctgcaaatattatccacggagtcctgcaatgatccgacctggatagagcagaagatccagtccatcctgcatagatctgacgcagagatccgcatttttcaataatttcccatagaccccttcccggtccataacagcgatggaaagcgccgcttctttcagcatccactcatcgtttctgccattaccgattgccacacagcgtcttgcaccggttgcttttaccaattcccttttatactcctttgcattacctgtcggaaatgtctccaggatcaccggaagcccttcgcactgcgctttcgcatttccatgcgtatctgcagtcagtacataaattcggaactgctctgaaagtgcgataagacgttccttcacactcggcgggatcacgccgtccacagcgatcgtcccgttcatatctaaaaatatcgtatcaagttctaatgttttatattccggaataaccagtttcataggaactcctttcctgccatctggcatgttgctttttctattataatacatatttcatacagactccacatattttgtaacaactgatttatctgataaagaggaggattgtaaatatgaaaccagttgttggaatcttatgctgtggcttcgacggcaaaaaccagtttgtaaccgatacctatgtgcgggcagtccgcatttccggaggaatccccctactgataccgattcttcctcaggatttcccgatcaattcttatcttgacatatgcgatggatttctactccccggaggaggtgattttacaccgtttctcttcaatgaagatccacttccaggtgtaggacaaaccaatctttctgtggatcttttccagattcattttgcagaggaaatcttaaaacgtcatcttccggtaatcggcatctgccggggtatgcaggtgctcaacgccgcctgtggcggaagtatctaccaggatctttcctgtcagcccggagatccttttctgcatatgcagacctcacagaaccgcagcgatatgtggcaccagattttcatcaccaaagacagccatcttcatgaactgaccggagacactctgtataccaatagttttcaccatcagtccgttcatctgctcgggaaaaatgtccatgcatgtgcacacacttctgatggcacagttgaggcaattgaaatcgaaggacagccttttgcacttggcgttcagtggcatccggaatccatgttttttacttctccatgtatgcgggaattgttttcgcttttcgtccggtcgatgcttcccggaacagactaaatcccttttgtcgggctgcagactctgctgtctgcggtcccttcagaatatatgtataatatgttcacaaacgttcataattctttcaaattataaacacacttttttcacaagatacgagtatactaataattgtcaaaaggaaataaaccttttcacataacaaaatttttctttttcataaacgccgatattcgggaaaccggatatcggctctcctcattttcaggggttatttcagatattccagaagtcctcgcaggtctggaacgacatgatctgccatctttttgacctcttcgtctgcaggtgtcagatccggaaccatcgtcacatggcagcccgcctggtaagccgcatttaccccgttcggtgaatcttcgaccgccatgcactcttcaggcttccgcccgatcttctcacaagcatagagatacacatccggtctcggttttcccaatttcaccatagatgcactgatgatttcatcaaacagctctttaaatccgaccatttccagataacgcacagccctgtcttccgctgtagccgtcacgactgccgtctgataaccacgtcttttcagctccttgatcgtctcttccacatacggtttcttctcaattccgaaacgcgcaatatgatcactcatcagttcctgtctgcgccgtctgagctcatcgtatgggaaatcctctccaaaaattcccttcatctgctctcttgcaaatacggatgcacagctgcggaatttgtatgccgtttccagatccaaccggtatcccgcctcccgcattgccttttgtttgtatactgtcagatatttctctgtatcgatcaggatgccatccatatcaaaaagtactgctttcatcttgtcctcctgtagtatatttcattttgtaaaaacaattactttctatatcataccattcccttcaggaagaaaaaagacggagattttattctccgccttttgaatgtttgcttatatctattttgtactttctgtgctgccggtacttcctgtactgtttgaaccgcttttgctgctgtcagatgaagtacttttcacctgcttgcagttgtctgctacccagtcttctacgatatccagtcttgctgtcttctccagattctccaggtttccagcatcttccagtgcttttttgagtgcatctacatcttcgtatccgtaagcctttgcatactccttatacttcttctcaagtgtcttatctgacacatcgatctttgctttctcaatgatcagatctgccgcaaggttggcctttacctgatcctttgcagcctgggttgcctttgaattaaaagtttcctcatccatattcatatattgtttaaggaaatctgcaaaatcaaggttataataagatgccatattcttatactgtgtcttgatcgaactgatcatattcttcagatccttcttcggatacttgttcacagttgtgttctcaagtactgctttccatgcattttccttgattgtattctgctggttttctttgccgttttttttcagagattttttaatttcctttttgtactcttccaccgtcttggaagtatcagaaacactctgtacaaattcatcggtaagttccggtacatcggtctggctgattcccttcagtgtaacggtaaatacaactgcctgacctgcaagatcttcatttccatagttctccgggaaagtcagattcagatcaaaagtatcgccaatattgtgtccgacaacgccatcctcaaatccgtcaataaactgaccacttcctaatgtaagctgtgcatctatcgctgttccaccatcaaatgccacaccatctttctttccttcgtagtcaatcgttaccgtatctccggtttgtgctgcacggtctgtaacttctgttgtagttgatttagactgaagtacactgttgatctgtgcttctacatcattatccgataccgcatccgcatctactttatcaatctccacacctttatattttgtaatcgtaacataatcattggaaatctcaccggagcatccggtaagaaataatgacaatgcacagatacctgctgccagtactgctaatttctttttcattttcttttacacctcttatatcttcattctctctgactgtccaaatcacccacatcagagcgctacatatgattataacacataatccgtcattgaaaagggatttcccaaaattcacatttatttcagattttccattactttcaaaaagccgccaaaaacttcaaattacttgcacttgtctacaaacaatgctacaataagctatgtgtaaatatgatttgaggaggaaaacccgtgagtaagataacgatcgtattactggtaattcttgccgtactgcttatcgccctggttgttctgtatttcctcggtaagaaagcgcagaaaaagcaggcagaacaggaagagatgattgcagctgctgcacagcaggtcaacatcctggttatcgacaaaggtaagatgaaacttaaagatgccggtttcccgtcagttgttcttgagaatacacctaagtatcttcgtcgttcaaaggtacctgtagtcaaggcaaaagtcggaccaaagatcatgactctgatgtgtgatgcaagcatctatgatcttattccagtcaaaaaagaagtaaaagcaaccgtaagcggtatttacatcactgcagtaaaaggagtcagaggttctcttgagactccacctaagaaaaaaggattctgggcaagactgcggaacaagtaacaaaaaagggtaaatgattctgagctgattgaatcatttaccctttttgttttattttcctgaaattgcttcctctgcctgtgctttcggtcttatgctcattgcgatccggcagtctgccgtcgcttcatgattcacatcaagcccgtactccacagcaatatcaattcgctcatcatccacattcacatccagcttccgtgtatgaattccaacatgaagctgcccatacggtgtatcataatatgtgacattcatctgattcttctcaaataccatatgtgcattcgtaattccgctcttcatgatctccatcgaatcttcaccggtgatcttgatcttattcttaaccacccccggaatcccttccattacttcatcataaagaatataatgctttccgttcttccagtaatagctcgccggagtgatcacctcaatcggctcattctcttcattttcttccggatttgcaaatgccatatcatgcagtccggaaatcgtcaataatacatcctgtgtcatacacgtcatccaatctgtctgttattagatggcaagctgttttgcgatatcatactggtactccggaattcctttctgcattgccagtgcttcgttgatatcaaaatcaatatactcgccatgtttgtaccctactacacggtttgtctttccttcaagaagaagatctacagcaagagatcccatgatagatgcataaactctgtcttttgctgtcgggcttcctccacgctgcatatgaccaagaatagtagcacgtgtctccatacccgtctctttttcgattctctttgccatattcatagaatcaccgataccttcggcattgatgataatgtaatgctttttaccgcgttttctgctttctttgatgtctgcaatgatctttgcttcatcgtagtcatgttcctcaggaagaagaatcttctctgctccattggcaataccacaccacagtgcaaggtatcccgcatcacgtcccataacttcgataacactacatctttcatgtgatgtagatgtatcacgtactttgtcaattgcttccatcgctgtattaaccgctgtatcgaatccgattgtgtattctgtacatgcgatatcaagatcgatcgttcccggaagtccgattgtatttactccaaaatcagataatttctgtgctcccttgaaggaaccgtctcctccgataactaccagaccgtcaattccatatttcttacagattgctgctgctttctgctgtccttctggtgtacgcatttcctcgcaacgggctgtcagaagaatcgttccacctctctggatcgtgtctgatacatctctggcacttaaatcaataatttcctcgttaagaagtcctgaataacctcttctgattcctcttaccttcagtccttttcccaatgcggttcttacaactgcacggattgcagcgttcattcccggtgcatctccaccactggtcaatacgccgatagttctgattactttttctgccatgatatgtctcctccgtctcttctactttgtaactttactatccttttgcttaatttatctcaatccacacgttattgtataatattcaccccttcatttcaatgggtttttctattacttttacacaatcttctccaaaataattcgtcaatctgctcaaaattccaggttctacctggatatttgcgtttttaggaagtctttttaccgctctctccgctttgcagaagattacaacctggtcctcaccctcactttccgcgagcatccggaacagattctgctcatcttgaaggtaactctgtttgtcggtataccggatccacagttcttttttcgtcatctcaaacggaatcacctcttcacagatcagcttacttgcattatcatcttcttccgatacacgtccccgcacaaatactttgctgtcctcctgcagatactgctggcttttctcatagctctgcgggaaaatgacaacctctaccgttccaagaagatcctctacggtaataaatgccatcgtttgattcttctttgtatatttgatcgtcttcgatgtgatcataccaccgatgatctcccttgacccgtcacgcacttttgtccgtccggtctcttcatcaagctgaaaatccaatgtcgttgcggaaatactcttgcgccatttctcttcatattcttccaatggatgtccgctgatatacacgccgagtacttctttttcaaatgcaagcatcgtttccttctggtattctcccacatccggaagcgtgacctcaaattcttttttctgttcgtcatctacaatatcaaagagcgacatctgtccggcaagcgaatttttcttgttctgtgctacctgatccatgatctgtacataaatgatcataaactgctttctggtccctttcagactgtcaaatgcgccggatttgataaagttttctaccgcacgtttattgacttccttaccggaaagccgttccagaaaatccttcagatcacgaaacgtgccatgctcttctctgtcccggatgatctgctcgatcaccggtcttccaacccccttgatcgccgcaagtccgtaacggatattaccgttatctacagaaaaatcaccaaccccacgattgatatccggcggcagaatagaaattcccatctgtcggcaagtgtaaatgtattcggcaacctttcccggattgtcgatgacagaagtcataagcgctgccatatattctaccggataataatatttcagatacgctgtctggtatgagacaaccgcatatgctgccgcatgtgatttgttgaacgcatactttgcaaaatcgatcatttcatcatagatcttattcgcaaccttttcatcgattccatttttgacacagcccggaatgccttcttcttcattaccatatacaaaattctgacgctctctctgcatcacgtcgccctttttcttactcatggcacggcgtacaaggtcgcttcgcccaagtgaatatccggcaaggtcacgcacgatctgcataacctgttcctggtatacaatgcagccataggtcggtgccaggatcggctttaactgcgggcattcgtaagtaatcagctccggatggttctttcctttgatatactgtggaatgaaatccatcggacctggccggtaaagagaaattccggcgataatatcttccagactctgtggacgaagttccttcatgaagctcttcatccctgcactttctatctggaaaataccgtccgtctttccggttccgatatagtcaagcactgctttatcattataatttaatttttctgttaccagcttcacaccggtacttttttcaaccagtctgatcgcatcctggatgacggtcagggtacgaagcccaaggaaatccattttcagaagtcccagttcttccagcgtggtcatggtaaactgtgtgactacattgttgtccgctccaagtgccagcggaacatattcatccacatccttctggctgatcacgactcccgcggcatgcatggatgtatgccgtggcagaccttccagtctctttgacatatcgatcagctcttttacctgtgggtcttcatcatagagcttcttcagctcatggttcatcttcagggatttatccagtgtaatattcagttctttcggaatcatctttgcaattgaatccacaaaagcatacggaagatccataactcttcccacatcccgcagcaccccgcgtgcctgcagtgtaccaaaggttacgatctgcactacccggtctttgccgtatttacgcacaacataatcaatgacttcctgccttctttcaaagcagaagtccacgtcgatatcgggcatagacacacgttccggattcagaaaacgctcgaacagcagctgataccggatcggatcgatattggtgatcgcaagtgtgtacgccacaatgcttcccgccgcagatccccgcccaggtccaaccatgattccgttgctttttgcaaaatgaatgaaatcccatacaataaggaagtaatccacgtaacccatgcttttgataacgcccaattcataattcaggcgctccacaagagctggatccgggtcttctccatatcgtcttttcagtccgtcaaaacagagcttattcaaatattcccatgaggtaaatccttccggcacatcgaatttcggaagctttgtcacaccaaattcaatctctacatggcatctgtctgcaatcttctgtgtattttccagcgcctccggtgcatatgggaaaagtgctgccatctcttcttttgacttcacgtagtactgtccgccttcatagcgcatccgatcctcgtctgcgagctttttccctgtctgaaggcaaagcaggatatcatgtggcttttcatcttctgcgtaagtataatgcacgtcatttgtcgccacaaggtcgattccgatctcctgcgacagacgcatcaactgctggttaacggtgcgctgttccgggatcccatgatcctgcagttccaggaaaaagttgcctttcccaaaaatctgttcataatgaagcgcagctttttttccttcttcatacatccctctcgccaggtttctctgtacttctccggcaagacatgcactgagggcaatgattccttcgtgataggtctccagaagctcataatctactcttggcttataatagtaaccttccgtaaatgcacgtgacacgatcttcatcagattggcgtagcctgtattattctcggcaagaagtaccaggtgataatatcggtcctcatcgcgtcctatggctgttttatcgaatctggatcccggtgccacatagacttcacatcccagtacaggattgattcctgccgctcttgcggctctgtagaagtcaatgacgccatacatgacaccgtggtctgtgatcgcagccgctgtcatccccagttctttgactctggcaacatattctttaattttatttgaaccgtccagaaggctgtattccgtgtggacgtgcaaatgcgcaaaattcatattgtgttcgctccttttctctgtgttccattttagcagaaatgagggggatttccaactggtgggggaaaaattttataggttggtgggcggcggatttccaaatatatatactccggttcccctcggcaaaacattccgatgaacccctgaaagcgggaatcgtgttaactttctttttggggcgttggtgtcacaaccttatttatcctctaacgcaaaaataccgccgcatcagatctcatttccaatgcgacggtttcttttcttactccactgcttttaccgcagcagacattttttcttcattttgttttgaaaaatacagttttgtttctccaatgatcacttttctaagtgcaatgattgcgatcaggttcggaataatcatcaacgcattcgtgatatctgccaggagccagattggttccagcgataaaaacggtgccagtgcaattgctgcaatgtagatgatcttatatggtttgatccatttcgttgtgccggttagataaaccaggcagcgttctccataataattccaccccaaaatggtggtaaatgcaaagaacatgattcctactgcgatcagatacatgcctatattgtgcggcagacacatgttatatgcagctgtaacaagcgtgcttccgttcatatccgaactgtccatcaacccgctgctgatgataactagtcctgtcatggaacaggtcagaatcgtagtaacaaacacacttgtcatggaaagaaggccctgtcttacaccagaattcgtcttcgctgccgctgcaacgatcggtgaacttccaagtcctgcctcatttgtatagacacctctggcaattccggttctcataaccgtcataaacgtgataacacccgttcctgcagtccctcctattaccgattcttttgcaaacgcacaggtaaaaatggccttaaaagcccccggtactgcagcccggttgatcaccagcgccactaccgagcctccgagaaaagtaagtgccatgatcggcactacaatttcagcaacctttgaaatacttttaattcctccgatcgttacaactgcagtaagcactgttacgatgattcccgccacaacaatcggtatacggaatgtcacattgacagattctgtgatcgcatttacctgcgggaacgttccgcagccaaataacgctgtacacatgccaaacacagaaaaggcttttgcaagccagataaatctctctcccataccattttggatataaaacatcggtccaccggccatctggttattttcgtccgtcactctgtattttaccgctaaaagactttctgagtatttcgtcaccataccaagtatggctgaaatccacatccagaataacgatcccggtccaccaattcgaagcgccgttgcaactccaacaatacttcccgttcctatgtctgctgccatcgttgtacatagagtcgcaaatgccgatacatctccttctccgcttccggtcccactttctttttcaaaaatggcccttactgcacgtggaaattttgtgatcttcagtcctctcaatttaatcgtaaagtaaagccctgtaccgatcaacagcaacaatgtcggaggtccccatacataactttggatagtcgtcagcatccccattaaattactcatttcacttctccttcgcctctgttattgttttccatccatattctatttttacgataatcttttccccactagatttttttcttcaccttcttaatcaacttgttttttgaaaaagctctctccgttcataaaattgttcatttttcttatttccgcttcgactttctttatgcatattatacataacatttctgcccgtgacaaatcaattctttttctttataatagaatttcttaatatataatgaacgtccattttcattaagcgacatgaaattatatttccaataaaattttacaaaaaaacaccgccgcatcagcttcattctgacacggcggcacgtttttctttcataaaactaatgggtagttcccataacctcttttacatcttctgtattattcactacagcttcaacacaatactccagagactttgcgattgtctcaagcggcatacttgccattccgttcgccttatctacaacctgatcgcaagcatatggtacatggataaatccggcacggatgttagtgtatttggttgcacacatatgcagtacattgtacattacacagttgcatacgtaggttcctgccgtgaaagatacatggcatggaagtccgtgagcacgtacattctgaaccattgcatttaccggaattgttgcaaagtatccggttggaccgtctgcctgaagtggctcatcaagtggctggtcacctgcattgtccggaatccgggcatctgcaaggttgattcctactttttctacagtgacgcaggaacgtccgcctgcctgacctacattgatcactatatccgggttatgttctttgattgccgcttcaactgccggtgcacttttcttgaattctgtagggatctctacatatacgatctctgcccccgcaattgttgacggaagaagcttgattgcctcgaatgccgggtttacgctttctcctccaaatggatcaaatcctgttaataaaaccttcatgttaatttcctcctttatatctcttagtataacacaggctccgggataataaccttcccctgctgcataatctgtcggttgtccgtgtagatatccggttccatacataccagatcaaaatgccctttggcgttctgaatacctccaagagcaatattacgcccaagtcctacatggaatgtcccataagcagattcatcttcaatatagcagtttccaaggcattgtgagcatgaattaagcccgattccgagttcccccgcaatatagatccggggatcctgataatcttccatgtattttttcaaccgaataccggtcggagtctcttcaatctccgtaatccgtccgcctttaaataaaatccttgtcggttcctctgcgcgaccaatatatcccagagaaccgtcaagcaccatcacaccttctgtctttgtctcctcgatcgggacatagacctcaatactggaagaagaatatccctttccatcctttagaactccgttaaaaaatcccggatctctgcccactttgtagaacatcatatccgttcctgccggagttgtcacacggactttttctgaatacttgagatatttgataaatgcctttgccatcagccggctcttcttcgtatccatcgtcaggaaatcgtattccagaaaagatcttccgtcattggttgccagtggcaaggacagaaatttcttgtgtctttgtatcgcacgctttgcggctttcgttgtcaccagcgaatactctgtcgccgcgataattgccgtataaggatcaaaaactgcttcattatcatcaaaaaagattcccacatggcgccccttgttctcgacaagcagtgtattcactgaccgtgcttttccggaagcctctttttccattgcttttgcttctgcaagatattccttcgatgtcacgatcagtactttgtcccacgcccttacttttacccattcgtgaataatgatccgggcaccccgttccatattcggtgtcatatgtccctcttctttctccataccaaaaactagaataagcttacgaattctaaggccattattttctgcctttccagtgaaataatgaccttagctacttatgtcttatttactttaatactatcatataacagatctggaacacaagcataaaaattgcaaccagaacctgatttttgatagcgccccagcggtccttcatgttcaggatcgcaaccggcaggatgttgaagttcgctgccatcggtgtaagcagagttccacagtatccacatgtaagtgcgagcataccgatcaccaccggattagcaccgtaagcaagaacgaacggtgcaccgataccaactgtcataacggtgatagctgcgaatgcatttcccatgatcatggtaaagagtaccataccgattgcataaatgatgatcccgatatttacatttccctttggaacaatcttttcaacaagctgtgcgattacatcgccaactcctgcagcggtaaatacacctccaagacatccaagcagctgtggcagcatactgagaggtcctgtgattccaaggaatctttcagaatcattcaaaaagactgccggtttattctgttttgtatcgaatgccatcagtaagaccatagctacaatcacaccaacggtaattgcgaccatagaactcatattactgaataatgcaaagaacagggagcataccgctacggagaatgccgggacaaatatcttcattccaatcttcttaaactgctgttctgtgtgttcctttgtcggattatctgtttttccgatttttactttcttgaagatcggcggcaggcacatgatcagaacaagcacaccagaaacctttgccgggagccatgaaccaaatccacaaacgataccgaaagagcaccagaaaacagcggttccgactcttgacggattctctttatccagcaggttcttaattcctgcgtaaatcgtgatcaatccgataattacccatactacattcagcccgattgcattaaacgaatcgccgacctgtataaattttaaattactcatctgtcttcctccctctatttcttagtatctgttgattttccatagtatttcttcatcagtttgttatctttcacaataacaaatgcgcaggaaacaacaagtgcaactaatgctactgggatttcagctgctgcaaggtcgatcagttctacttcgtatccaagacctgcaagcgttgtctgtacaaggattccgccggcaccacctacgaacagtacctggaagaagaaccatgtgaagttctgcatagcaacagcaagtccttttgcttcttctacgtgatcttcatttgcttttccttctttattgctgatcgcgccttcgatcatcggaagcagtaccggacggataaatccggcaactccaccgaagctgacattgaatgctccaaacaaagcattcagcataccatatacagcaacaagcttacctgctgtcgcactttttactttacggatcaggtttgccgctgcttcacgcagaccgtttctttccagtgtacctgtaaccagcaggatcatgataaagatcgccatacttctgttcgctacaaagtttgtaccgattgtttccagaagtccgtccactccaagtcctccaacaatccctgtcgtgataagggccaggaaaataatgaggattgaatccagtttcagcgcgaatccaacgattacgattaacacgccaagtaatttgatgagttccatacctaactcctcctttagaaaagtattaaaaagttatttattttttccagtcactttgacaatcatcggacgctgtcttatgtaactggtcaaaatctgtccatcctgctcttccagatgacattccatcacatgcactgcttccatcaacatccggatagtcgcctcgtcatgtgccacatgagcccttgcacacaaattcaggtattcaccctgtgcggtctcatctgcaacctcgctggtataagcaaccgttgtgatccacggaaaacggatcgacggataacgatggtttggatctgccgcgaacgggatccagtagttgatcatttctttataatagtttgccgggaacaatttcggcatccatgcatgtgcatatttttcaaactgagcactccattcacggttcaattctctcatctccggatactcggcaatcttgtctgcaatcacatcttccattaccttattgaccgggtaattgtccttgtactctggattggtcacataccagaaataaccataaagcagagatctcggaagccagaagcctttgtaagacggggaggtataacctgaaaactgctgctcccattcatggctcggtactccgtgattgtccacgatcatatccgggacataccggtcataaatacgggttaatcccatcgcctcgctgtggatcgtatcctgctggaaatgttcatagtagaactcttttccaagcgaattaaatcttgccacatggaatttccaggttggatgctctttctgcaattcataatggattgccgcaccatccacattttccatcggaacgatcactagattcagtttatccggtaaatctttgtaaacatcttctgtcagcagcttcttgatcaggataaatgctgcatttgtcgaagatacttcatttgcatgatgtcttgcattgatcatctcgccaggaattcttgatatacgcttcgtcatggacagatatccttcgtattccggtttgatccatactgcatagagttcacgtcctgtataagataccgcagtccggaacacttcgattccaggaacctgcttcagttcttcgatgatctcacggtaaatatcatatccgatcagttcatgctcatgcaggtcaatctcttcaatccgtttcgtctttggtttttcttctctttccggtgtaagtgctgcatactgtatctcgccctgctcactttcaaacaaaagcttcgtacctgctgcaacactttcacactctgccagtacaccctttgaccacaatgttgagtaagtgtgtaatacattagattgtacaccatttgtgcggatatggaaagtaaaattatcattttcccatgaaatggcacggatccatgcatctgcttcttcccgttttctctgtaaaagaaccgcttttccatcttttacaatgcatgcttcttcttttaacggctcggtcagtgtcaccttaaataccggtctgccttctttttcatggatcaccggaaggatcagtcccggcgcatccagcatgacatctgctttcttcacaccgtaatttttaaaatagtcgcttccgacaaaatacatatcttcatgcaaagcatccagtgaagagatcagatcctctcttgatccggtcgcatagtccggttcacttgcggtcacgtccagacgcagttcatggaagaacggctgcaggtctgcggaaatctttccgcctgtcttttcctcaatatatcgtctgcaatccggaagaacttccttctggtaaacatcccagatctcttccatatcggtacggacggtctgataaaatacttcctgtccgtcaatctctgcttttacataaccggttgccggatgaacctttcccatctgcggatattcatccatatatggtctttccgaccagactgctttgtaagtatcctcacagcagaccttttcgtccttgatccccttgcagagataagtgatatcttcttcgccttcataagctttgaaaatgactttatctctttcaattccaagctcttttaccagaatatcttctaccggatacagttcctgcagatagcggatcggaagatcataccacttgtccggagtgtctgcattcagattgtgataggacggggttgcaccgttctcatccagccagtctgtctggccttccggcaggaacggtttgaaataaatctcaacctgatctgcctgcgcttccttcatcaccggaagcatctcttcaacgatccaggaatatccctgtttgtatgcacagataacggaggtatcctccggcttggcacctaacatctggattctgtcttcgattttttcttttatcttctggcgtacttttatattttcacttaccgcaccggtaatctttaccttgcttcctttcccgatctgcggataaaccttttcttccagaagtttttcaaaaacttccacttcccacggaagctcatacaccttctcgtacatcttctgtccggatttgtaattatatacctttgcatccccggcttcttttttctgtgtatcattccagagcggagatccgtacacttcgtattctcctgtctgctctttctgcatcgctttcaaagctgcaagctggccatctgcgccgcgcagtacaaagtcatccaccatatccatcagcaagtctttccagcttctctgaccattgatctgtggaaattccatacagaggcgggaggtaaatgcgattagttcctctccgtcaccgcgaagagatacttttacactttctccttctttttcccgtacaagctctgtctgctctgctttttccagaacgagccggttgcctgtataagctgcatctgccgtaatatttcctgtatatccggttgtctccataccaaaacgccatgccaggttacatgctgcaacgagcatcgcatcatctgcatcctccggaagtacaatcttcacatccaacacatccggaagaagatcctgattctcgtctttcaggaaatcccctttctgaagcatcgtctccagccctttttccttacggaaatccagatcaaagatcggacctgtatgctttgatgctgattcgtactcttccggtgtctcccctgtactctttttccacagggctttcagctcttccatattctccggcaccggaatctcaccgtccgctgtgatcaccggaaatgtagctgtctctgtctgaaatcccagaagtagtgctgcttcaaccgcataacgcttctgttctcctgtcatgccggctgcaagttttaatttttccatcttacacctccaaaagcactgtagttcgttttcgtactacggtctaaaaagatactgtattccgaactacgttctgctttttataccattcattctactaaagtgttcaaataaagtcaaccatattatccttatatggacattttcaataaaatgtatgcagaaacaaaacattgcactctccacatccctgtgttacaatagcttcaatacttttaagaaggcaggaacgatcaattatgacaacgcacggcaaacgacatgcaaaacaggacatcatggatgcagcatggaagctgttcacagaacagggctatgacgaaactacgatcgcgcagatcatcgaactctccggtaattcccgcagcaccttttaccaccattttcgtggaaaagatgaacttctcttcagcctcgcctattcctacgacagtgactatgatagctggcttcagacctgcgaccggacgcttccagccgccgatctgctgctcgccttcaaccattttgtgctgaataacctggagcactcaccatatatggatctctttgcgcccctctacggtcttcaggtagctactaccggaaccagacatattttaaacccggatcgtaattattataagatcctgcgcaagatccttttcgatgggatcaaatgtggagaactaaagtcagactactcctacgtcgaactctcccagatgatcacctctgcccagatcggtctcacctactcctggtgtctcacccagagaagcttctccctgcttcaatacggtgaatccctcctgacaccatttattgaatctttacgcgtcaactaacctgacccaccctcaatataaataccctctcgcatataccaggaaactatctctctatagtttcctgaatttttatgtttagcagccgccaggtctgcgcccaaagtcttgagggcggatttagaaaaagaataggtgtgaaggcacttattgtgcaatggagatgagactcaaaaattgtggaagcctttgctgacacaattttcgttctcagaggctcatcggaatgccctgcacagtggacttcacacctattctttttctaaatccgccacacaacctccccctcgcagaccgtctctctccacaatcgagcaggctgactcctactcgatttgtatactttgtacaccatctcgcttaacagctcgatgatgtacattcgccaaatgcagatccttgtgcaagcacaaatctgcacttggctcatcgtatacacaaaaaagcaggaaccaaatcattttgattcctgcttctcactattcctggtatttatataaattagccattgatcatgaagttaaccagtttatcgatgtcttctttttcgtatgcaatgatttccagttccggaatctctccgttagagaaaatatttgccatagaaacatactgagaaagtttagatttcagattcagtctgtcgccttctcctgttacaagttctacttttcctttgcagctgtctactacttcaaaaaacttatcaatgtttgtaatattctgtaccttcatgatgtacactccttttcttttatctcttcctatcttttacaccctcaatatatacaatttttttttgaaaatcaagggttttttttcaaatcagcgttttgggcattgtgaacaatttaacagtctgttttttgtgcataatcacaatgtctatttcaaaacaatactgtccttacggatctcgatcttacgctctttatacagatgtccgactgcacgcttgaatgcattcttgctcagatcaaactccgcacggatcacctccgcatctgctttatcgttaaacggaaggactccgcccttttcttccagacgcgccagtaccagaagcgcatccttatccatctggataaatgctttctcacggacacttaaattcagttttccatccggttttacttctgtcactctcgcatggatcttcattcccggtcttagacttttcggtgcttctctctttggcacaagcgcagaatattttccgtccactgcaacgaaagtcccgaaattatcactcacttcgtaaacgattccctctacctgatcatctttctgataaggagaatcactggtcagatactcatataccttcatggtcgcacagagtctctggctcttatcaatataaagtcctaccagacattcatcccccggtttcaccttataagtctgctccttaaatggcaggaacagatccttttccagtccccagtccaggaaggcaccgaatttgccaacctgcgctaccttcaggattgcactttcccccagtgtaagcttcggttcatttaccgttgcgatcagacggtcagaagaatccttatacaaaaacacctcaatcggatcgcccggttcgattcctgccggaacctgcttcttcggaagaagaaccttttctctgtcatctcccagatatactccgaaatcaactacctttactaccgtaagcatctgtttttttcctaattccatctcttatttctccttgaattctactaccgcatacggatttccctccgcatcacaaagttccactatttttctctgttcctctaccgccatctttggataaataatatcacccataactgcggattttttatattctacccggatctgtccggcacgctcacattccggcaccacatcaattgccatctggatatactggcagttattgacatgctcgtttgtgtcgatctgatgacgtcttaccggaaaactttctccatcttccagttcttttggaagcacgatcttacgcggcgcaaactctacatccagtggtgcttccggccgataagcctcgacctcttctttcgccggtctgcatggtcttccttttttcatatccatatatacccagactgaattggcccaggctgtcatctcgcctgcttcatcctccatcttaaaattacgaagtccgaaaagtccggtaaaatccgttgcccaggtggacacccggatatgttccccgagtttcggataacggtttactacaatctgccatgcagaaagaatccatgcctgcccgctttttttcagtgattccacgccatatccgatatcctcagactgaaaagtactacagtcctgaaaataattaacaagccccggtaatgtcagaagctccgtatggtctgcttcactgaatcgtactctgctttcaaatgtatacatctcttttacctctgttcttccacataacttctgtctaatgtgataacacactgatactttgggttatgatgctgcaatcggtccatcaaagtcagtgtcagttcattccctttttcctcagaatactctctcggaatgacaaaatcaaaaatgagattgatctgtttttctccattcaccatgcggaaatcatggatactgcatctcggatccagtgcttccacagctttttctgtctcatgttttgcctgaagtacttcttcattacgagtctccaccggatccatatgaattgtcagcgagatccccagttgttccattgcctctctctcaatccggtcaatgatctcatgggatacatcaatcgggacatcattcggaacctctgcatgaatgatcgccatacttcttcccggtccgtaattatggatcaccaggtcatggctgccctcgattccagcgtatttttccacaaaatgcttgatcttctcataatcttcccatgtcgccggaattccgatcagcggctcaagcgtatccttcgcaatcccaaatccggcccacataacgaccagtgaaacaccaagtccgacaaagccatcgatattgatccctgtgatccgccagaatacaaccgacaggatcgtcgctgctgtcgtgatcacatctccaagtgcatctgctgccgtcgccatcatcacctgggaagaaatcttttcaccaagtttccggttaaacatcgcaagccacagcttcacacctatggacaacaccaggatcaggatcgacaccagactgaattttaattcttccggctcccggatcttcacgatcgcatttttgaaaaaggtaaatccaacttcgatcaccagaaaggatacgatcagtgccgctatgtattccagcctgccatgcccaaaaggatgctccttgtctgccggtttttctgccatcttcactccgatcattccaatgatcgaagaacctgcatccgataagttgttaaatgcatctgcagtaacagacacactgtgaagaaggattcctatcaccatcttcgcaatcgtcagcagaacattacaaaagatgcctactccgcttgccagcactccatatgctgtacggacagacaccttttctacatctttataatcttttacaaataattttacaagtatatccgtcattaaactttcctttgccttaggcgaaacaaattttcctgccatcttcgttgaagtatattctacacatttactccgtcaattgcaagaaaaaccatttgatttttaccggtgtgccttttacgatcatcgcatactcttcatccgtcagcacactccgcagctcttccttcccttctttgggaacaattgcatggacagaatccataaaacagagattcggataaagaacacaccaccagttgtgcccctgtgcctttccgatcttgatccggagtgcatcgtaccagcctgcggggaaggtgatgtctccgtaagttttgtccggaaattcacaccgcacgacctcagctgttatctgatcgttacatccttctttctgcaagacttccctggccgtccggatcagttcttctttgtggcggatcgcccatgctttcgcctccgctgcattccctgcatccgaaagattctcacacatataatctacaacagcctctttcaccttcatcttaagttcctggtcttctttgctgtcactgttggcaagcacatgaaagcggaacacctcaccggataacttttcctgcactgcattcgccttcgcttccacctgcattccccttgcaaatgccgcaccacacagaatcatgatcagtaccagcaccactgcttttatttttttcattttcgtatgtacctcctgtctttgataccaggagtattgacaacatatggaaaactatacatttttatctgtgatattctacctgatcttttgaagtgattaatgaggttgccatgcctcgcaaacccgcataaatactgaatgtgtggagttttgctcatggctaatgataaagataacggaggtgaagactatggaaacaaaaaatgttattttgaaacttcgtacggaaagaggaatgtcacaagacgagctggcagataaaatcatggtaacaaggcaggcagtatcacgttgggaaaatggagatacggttccaaacactgatacacttaggctgttatcgaaagaatttgatgtttccatcaatacgcttttaggagaacccagaaagctgatttgccagtgctgcgggatgccaattgatgatgattccatattgggacgtgataaggatggcacattaaatgaggagtattgtaaatggtgctatgcagatggaacatacacatataatgatatggatgaattgatcgatgtgtgtgtaaagaatatggtaaatgaaaactttaccgaagaacaggcgcgtacttatttaaaagaaatgcttccaaagttagattactggaacaggtatgatgaacttagtgacaatgggcagtttgaagagtttaaaatgcaattgataaatgaaataaatgatctgcatataagcggtcttccaagagtagacaaactaaatgcacttgtggggaaatatgtgaatctggaatatactctgcctaatggacaaaaagtgaaattccttgatgatcagaaaacctatctggggaatcaactggagtctgaattcggaggagacagatgctttggcattctggcaagtatggattttattctggtatgtacatatgagaaagatggtgaaaatccagagctgttgatttataaaaagagataatttaagtaaaatgaaagctctcgaatatggaactgatctccgtcaaatagacaattgaaaaaaataaaattttcctgccagtagattatctgctggcagtttttttattacataggaaatgtcatttcctatgtaataaaagtctccggcaggatgcgcactgcggcgtacaatgaagatgagaaataaattattctgttgtattgcggcgaattaatataggtgtaatctgtttatgaataggtttacctaatggtttgggaacacgctttttctgattttccatctgctggatcaaaagatccatggcagtttttgcaatcacattgatctgctgtccgatggttgtgatcggaaggattgcttcgctggcaatcggagaattgtcaaatccaacaatttcataagtggaaggaaatgttccgtatttttggaaaattaaattaagaaacatattagcataggtatcgttcgcaagaaagataccctttttttgatcggggtattttgattctatcttgttgaaaatgtcccggattacatttaaaatttcatgataagaatgaccttttacacttagatctatatcatacggaatatgatgttcttcacaagtttcctgaaaggctcggattcggtcataagctggggcagatttatttacattgacatttatatgaattaatatgttacatttatcccggatcagcagggaagtggcctgaagtgcacccatgtagttatctgtattgacactgctgatatattctgcttcacgctcaattgcaatgacggggatctgataggaagcgagcttctcagatggaagagtgtggcttaaaactatcagaccctcaatctgataagagagaagttcttcaatgtattgctgttcttcttccgcaccatgttcactgacgaaaacaagaaatttatagtgataatcactgtagctggaaagaaactgtgtcagcatctcagaataatagtgcagataaaggttcggaataatgattccaatgaattcactcttcccattcgccagaatctttgccagcttattctttttatatccaagtgtatcaagagcctgtgatatcttttcctggttttctaaagtaagagaatcaggatgattgaagtatcgcgatattgtagtctttgaaaaattagtgtatgctgcaatatctgcaaaagttacctgttttttacccataaaagttgaatctcctccaatatgatgtgatggccgaaatatgacagccggtggtcaataatatcttttagtatagcaattttcaagaaaaaacgcaatgttaaaataaccgattacgtaaccggttattttaatagacaaaagtgttgacagaatgaaatagatatagtaatattaaaccataaagtaaccggttacttaaccggtttcgcacgaagagtaaatggaatggaggaagaagtgcatgaaaaaaatgcaaaatcaagcaaagtccgtaagcaagcgaacgtggagagaaaagatgacttatgtgaagaaaaactggcagttatatcttttcttcctgatgccgggacttttactgacaattatttttaagtatctcccgatgggtggtcttctgattgcttttgaagactacaatgtaataaaaggagtttttggtagtccctgggtaggacttgagtatttcagacggttcttatcttcaccagatttcatgaattatctgatgaatacgttgaaagtgagtatctatggattactgtggggatttccggttccgatcattcttgcattgcttttgaaccgtattcgtaagactggaattaagaagaaagtgcagcttttgatctatatgccaaactttatttcagtcatcgtgctttgtggtatggttcgtatgcttttatctccggttggaccgctgaataaagtactgggaatcagtacaaactggatgacaatgccttccgcattcaggacaatttacattgcaagtggaatctggcagaccgcaggatgggcatctatcatgtacacagcagcgctggcgaatgccagcaaggagctggaagaagcagccatcgtggatggagcgaatctcctgcagcagatctggtatgtagaattgccggcaattaagaatattattgtaattcagtttattttgcaggctggaaatattatgagtattggtttcgaaaaagcttatgctttacagacagatatgaaccttccggcatcagaaatcctgtctacgtatgtatatcgtattggacttctgaatggagactatggatattcgacagcagtaggtcttttcaattctgttgtaaatgttatcttgctgatctttgtgaactgggttgttaagaaactgaatgacggagaaggattatagaaaagagggagaagagatggagaaaaaaaagaagaaaaaatattcaaggacagatagagtaatccttggaatcggatttaccattcttggtttattcgtcctttctatagcaataccgattatttatgtagtacttgcatcctttatggatccgactgttttgaataaccagggattaagttttaatattaaggactggactttagatgcttatcgaagagtattagagaatgaaatgatctggcgtggatttttgaattccttcctgtattcacttgcatttacagtaatttctgtttttgtgacattgctggcagcatatccgttgtctaaaaaagaatttgtaggaagaaaaattttcaatattattttcctgatcacaatgttctttgggggtggaatgattcctacatttatcttgatcaatcagctgcacatggttaatacggtgtgggcaatcctgattccgggggcatttaatgtatggaatatgattctcgcaagaacttattatcaatcaattccgacagaattaagagaagcatctgcaattgacggggcgaatgaaatccagcatttctttaaaatcatgattccggtatgtaagccgatcattgcagttctggcactctggtcttttgttggaatgtggaacagttatttcgatgcaatgatttatttgaatgatgcaaatctgcagccattgcagttagtgctccgttctatcctggtacagaatacaccacagccgggaatgatcgctgatatccagagtacggcagaaatggcaaaagtagcataacagcttaaatatgcaaccattgtagtatcaagtttaccactgttagtaatgtacccattcttccagaaatattttgataaaggaattatggtcggatcggtaaaaggctaataagaaaggaacgatacggatatgaagaaaagaaaagtaaatgcattactcgcaattgtactatctatgacgatgatggtgggggttgcaggatgtggaaaagagcagcagctcgcagctgaaattgatccggatacacctgtatcggaagtgcagtttccattgaaggaaaccgcagaactttcctttattacaagtgcaccggctacatcaacacaggagccaaatgaacgagtgatctttcagcgcatggaagagcagaccaatgttcatattgactggacttgttttgtatcagatcagttttctgataagaaaaacctggcacttgcccagtttggaaatctgccggatggattattcaatgccggaatgagtgagtatgatctgttacgttatgcaaagcagggaatcattattccattggaaaatctgatagataaatatatgccgaatttacaggcagtatttgaaaaatacccagaatacaggacgatgtgtacagcaccggatggacatatttattcatttccatggattgaacagcttggagctgggaaagaagccattcaggcaatcggagatattccgtatattaacaaaaaatggctggattatcttggacttgagattccgacaacaacagatgaattggaacaggtattaattcaattccgtgatcatgcagatgaacttgaaaaagaattttcaattgaaggtaatgtgattccaatgtcatttattatcaataatggggaccaagatccggcaattctaatcaatgggtttggagaaggttatggagacacgggagatcatttcgctgtaacggatgaaggaaaagttatttacacggctgtacaggaaggttataaagaaggaattgaatggttacataaacttgtgacagaggatttagttgacccagaagcatttacacaagagtggtctacctatgtagcaaaaggtaagaaccatcgatacggtctctgttttacatgggacattgcaaatattgataacaatgaagattatgtgatgctaccggcactgacagggccgaatggcatgagaaatatcacgagacagaataatagtgaaacaagtggatttgaccgtggaagatgtgttcttacatcaagttgtcggaatacagcacttgctgctgcatggattgatcagatgtatgcaccacttcaatcaccacagaataactggggaacttatggagaaaaggattcctttaacatttttgaactgtccaaaaataaagatggcggagaaatgctgaagcacatggatcttggaactcagtcaccggtagaagtacgtgaggcacaatctgtaaatggtccacttgcggtactgaatgaatattatgatgtatatgtaacacagccggaagatgcaaaatggcgtttagacaatatgcatgaaacttatctacaggatatgaacagcaagtatgtttatccaaacgtctttatgagcattgatgataccaataaagtatctcagtacgataccgatattaaaaaatatgcagagcagaagaaagcagactggatcttgaatggcggaattgaaaaagagtgggattcctatctgaagaaaatggaaaagtatggactttctgattatctttcaattaaacagaaatattttgatcagtatcaggagtcattgagtgaagaaaaataacgatatgaacaacaggagaatttgcatgagtgagatgttagaaaaggctagaaaatatgaagatgaacagggaaagcagataaaagcagaagacagaccggcttttcatgtgagcccatatatcggatggatgaatgatccgaatggtttttcatactatcagggagagtaccatcttttttatcagtactatccatacgatacacactggaacagtatgcattggggacatgtggttagtaaggatttgcttcactgggaatatcttccggcagctttggcaccggatgaagattatgataagattggatgcttttcaggaagcgcaatagagttggaggacggcagacaactgctcatctatactgcggtagatcaggaaaaaatggaagatggaactgtaagggatattcagacacaggcagtggctgttggagatggaaaagattataagaaatatgagaagaatccggttctgacagccaaagatcttccggagggtgcaagtaaagtagatttccgtgatccaaaaatctggaaaggaaaagacgggaaattctattgtgttatcggaagcagaccggcagacggaagtggacagattcttctttacagaagtgagaatggatttgactgggaatttgtcagtatccttgcagaaaataagaaacgttttggaaaaatgtgggaatgtccggatttctttgaactggatggaaaacacgttcttttgaccagtccgcaggatatgctgccggaaggcttggaatatcataacggaaacggcactttatgtatcataggagaaatggacgaagatacatataccttaaaagagcagtttacgcagtctgtggattatggaattgatttttatgcaatgcagacggtgaaagcatcggacggccgcagaattatgattggctggatgcagaactgggacacactggctcatcgtgataatgattcgaagtggtttgcacaaatgagtctgccgagagaattatctgtgaaaaacggaagactttatcaaacgccgattaaagaacttgatgcaatgcgtaaaaacagagttgagtacaacaatgtagtaataaataatgatacgatttcattagataaaatcgaaggacgaacgatagatatggagcttgtgatatgcccggaagataaagaaaatatgtataagaaatttggattacgctttgcgaagaatgagaagttttatacagaactgagcttccgtcctgatgagtctgtactgaaaattgatagaaaattttcaggaaccgaaagagcgttggttcatcagagaagatgtctggtaaatggagacaccaaagaattaaagcttcgtgtgattttagacagattcagcgcagaaatatttattaatgatggcgagcaggtaatgtctgcagttatatttacagaacaagaggcaaaaggaatttcgttctttgctgatggtgcagctaaaatcgatgtagtgaaatatgatctgatttagaaaatacatgattgaacttacactgagattgaaaatgcatggataatgataggggattcctgaaacggggatcccctttgtagtataggagcatagtatcgatgatagaagaaagaagaaaaagacatgagaatgaactgcatgaaaagtatctgcagttatatcacaatgaacaatgttatgaagaattaatgcaaatgctggaagaggcttatcagaacagaccggcggaacttaggagattagacggcagaagggagaaggaaccgaactggtatcgtaacagaaacatgcttgggatgacgatgtatccgaagttgtttgcagggggattgaaaggtgtgatagaacatttagattatctgtctgagcagaagatcacctaccttcatttgatgccacttttgaagatgcctcatccacataatgacggtgggtatgcggtagaagattttaaacaggtagatcccgaaataggaacaaacgaagagttaaaaagactgacaaaagagctgagaaaacgcgggatcagtttgtgtctggatgttattatgaatcatacggcagatacgcatgagtgggcaatgcgcgccaagagaggcgaacaggaatatatggatcgctatcagtgttatgaaacgcgagagattccggatcaatttgaaaagacgatgccacaggtgtttccggagactgcaccgggtaactttacatggtgcgaagagatgcacaggtatgtattgacaacattttatccttatcaatgggatctgaattatcataatccgaaagtatttaacgaaatgatcgggaatatcctgtatctggcaaatatgggagtcgaagtgtttcggattgatgcagttccttatatctggaaagagttaggaacgaattgcagaaatcttccacaagtgcatcttattgtacgaatgttacgaatgattcttgagatggtttgtcctggtgtaatcctgaaaggcgaggttgttatggaaccaaaggaacttccggtttactttggaacagaaaacgaaccggaatgtcatatgttatacggagtttccagcatggtaaatctgtgggcagcactggccacaagagatacaagaatgttaaaacatcagatggatgtaatccacagtcttccgaagaattgttattttgtcaattaccttcgctgtcatgatgatattggctggggcctggatgaagagcaggagaagaagctggagatagatccgattcagcacaaggaatatttatatcatttcttcgagggaacatatccgtacagctttgctcgtggagagttgtataattacgatccggtgaccaaagatgccagaagctgtggaacaaccgcaagcctgtgcggaatcgaaaaaggcggatttgaagggaatttagaacaggtgaaacaaggaatccaaagagtgctcatgatgcatgcggcatgtatgagtatggagggatttataatgctttcatccggggacgagatcggtcaggtaaatgattatgattataagaaaaatccggatactgctgcggatagcaggtatctgcaccgcagtccgttccggtgggacaatgcagacaagagaaaaaaagcgggtacagtacagtacgacatctggaatggtctgaagcagatggaagaaatacggcgtcaggataattgctttggagaaactgccggtatctctacctgggatacaggaaattatgcggtttttgcaatcagaagaacagcgggaaatgaagaattgatttgtctggctaatttttcggaatatggacagaatgcatggctgaattgtctggaaggtgaatacgaggatttatttacaggagaaaaactggaaatgaattcggtatggatgaatccttatcagtacagatggtgtgtgaaaaaaatgtagtcgttttcaagcggcagaatggagaatacgatgaaaaaatatgatgtagtggcacttggagaattgttaattgatttcacagaaaatggaaaaagcaatcagggaaatccgctttttgaggcaaatccgggaggagcgccatgcaatgtacttgcaatgctgacgaaactcggacataagacggcatttatcggaaaagtaggggaagactttttcggagaacagctgagaaatgcgataacagaagtagggattgatgcagacggattatgtatagataaggaaatccatacgacacttgctatggtacatacttatcctgatggagacagagatttttcattttatcgtaatccgggagcggatatgatgctgaataaagaagaaatttgtgaagaaatcattaaaggaacgacaatcttccatttcggaacattgtccatgacacatgaaggggtacgggaagcaacaaaagaagcaattcgcatagcagaagaatctggtgcgattatttctttcgatccgaatttacgcccaccactttggacttccttggatgaggcgaaggaacaggtattatatggccttaagcattgtcatatcctgaaaatctcagacaatgagattcagtggctgacaggagaagaagattatactgcaggggtaaactggatcagagaaagatatcagattccgctgatccttgtatctatgggtaaagaaggaagtcgtgcatactataacggaatgatggtagaagtaaaaccgttccttcagaagaatacaattgagacgacaggagcaggagatacattctgtggttgtgtattacattatatctgtgaacacggaatggaaggtttggaggaagaaaacctgaaagaaatgctgacttttgcaaatgcagcggcatctgtgatcacaacaagaaaaggggcactgcgtgtaatgccgacaaggaatgaaattcagaatattattcatggtttataaaaactaaacctattgacatagtaggtatatagatgtattataaatacgacagagaaaacagttatgaaatctgtaacaagtcggtgcaggcagtggtcaggaagttttacgagaatatagaataaataagagcatgcaataaatccaaaataacggatcattttgaaatgttttccggtatgtgtcggatcaaacgttttatgaattttatatagaagacggaagcagcagagcatcttagatggactgaacagaaagcatgtaatcgtggtatttaaagaatagttatagaagaattaaatattaacaatatttatagaaaaaaacaattggacgtataaatgtaattcatgtatactacacaaaatagttaaaacgtaccaattttaggaggtaaaagtatttatgaagaacacaagagccataagagctatagcattagctatgtgtgcaacattgttatttgctggatgtgggggatcaggtaaaaaagcaagttctgataattcagcaagcacagcagcaactgagacaaaagatgagttacatattgcggtttcagcaaacccaccttcattggatgtgcagacaagcaactcttcactggtaggtgagattgcggctcatgttttcgaaccattatttgcaatggatgataaatatgaaccgacaccggtacttgcagactcctatgaagtaaatgatgatggttctgtatataccatcaaattacgtgaaggtgtaaaattccacaatggaaaagaaatgacatccgaagatgttgttgcatctatgaaccgttggattgaaaattgctcaagagcaaaaactttgcttgaaggatctgtatttgaagcagtagacgattatactgtaacgctgaccgtaaacaaaccggcatctgatatccttatgattcttgcaaatccgtctatgtttgcggcaatttatccaaaagaagttgtagattcggcaactgaggaaggaatttcagaatacatcggaacaggtccgtacaagatgacagaatggaaacaggatcagtacgttaaacttgacaagtttgaagattataagaactcagataatgcaacaacaggtcttgcaggaaagaaggaagcagcaactgctactttatggtttgatattgtaccggatgtttctacacgtatggctggtgttcagaacggacagtatgatatcgcggaagaggttccgactgataattatgaagaattatcaaaagacaagaacctgaagctggatgtaacaaatggtggtactttgaatctgttcttaaatacaactgaaggcatcatggcaaacgaagatatgagacaggcagtacttgcggttctgaactgtgaagatatcctttatgcaagttatggtaacgaagacttgtacgaattaaatgccggatggatgaacttaagcgatgcacagtggagtacagaggctggcaaagaatattacaaccagaacgatgaaaagaaagcaaaagagcttcttaaaaaggctggttataacaacgaaaagattacacttgtaacaacaccggattatccggaaatgtacaacgcaaccttagttcttcaggaagaacttcagaagatcggtgtgaatgcagttgtagacagcaacgattttaacacatttatggaacatcgttcagatccgaagcagttcagcatgtacatcacaagtaactcttatgcacttcttccagttcagttatctgcacttaacaaggagtgggcaggacttgatgcaccggaagtaacagacggaatcagcgcaatccgttttgcagattctacagaagatgcaaagactgcatgggaaaacttacagacattcctgtatgaagatggtgctgcatctgttatcggacattacacttctgtaaatgcattaaatgcaaaagcagaaggatatgagttctcaagatacgcactttactggaatacaactgtttctaaataggcaaatgatggaacgacggatagcagcagcgtccgtcgttttttaaaaggagttaaaaaatgttacgatatataggaaaacgaattttatcactgatcccggttatgattgttgtatcatttgtggcttttctgatcgtatatatgatcccgggaggaccggcttcctcaatcctgggactggaagcaacagcagatgaaattcatgatttaaatgcacagcttggttttgacagaccattttttgtacagtatggtgactggatcgtgggagtattacatggagactggggaaactcctacttcctgcatgaatcagtcagcacactgctcggagaatatttccttccaacaatcagtcttgcaatctttgcacagattattgcactctttatttctatcccacttggacttatcgcagcatataagcgtggtacagcaatcgatatcacagcagttactgtttcactgatcggttctgcacttccgggatttctgctcagtatgttcctgatgcttgcactcagtgtttataatcatatattcccggttgcaggttatgcggatctttcgcagggccttggtgagcacctgaaatatctgtttgttccggcattatcgcttggaattgtacaggcagcatatctcacaagaatgatccgttcttcgatgctggatgtgctttataaaaactttatccatacagcccgtgcaaagggattaaaagaaaagaaggttcttcttgtgtacggacttaaaaatgcggctccggttattttaacagcagtcggacagtctttcggcagtctgatcacaggaacaattgttacagaaaccattttcaatattccggggcttggtaccttgacgatgaattccatcaaccgaagagatgttttcgttattcagggcgtagtattattcgtaacgttattgtatgtattggtgaatctggcagtagatattctgtatggatttgttgatccaaggcttcagccgggacgtaaataggaggaaaaagatgtattttacaagaaaaagtatgtccgaagctagtgaagctattttcagagagcagaggcagatcagaaaagaaaaattattgtcaaacccgggacttatcattggtgcagttggctttaccataattctgcttgctgcaatctttattccgatgttcagttcggtgagtccgaatgcaatgacagttacggaacgtttccaggcaccatgtgcaaaatatatattcggaacagatgaatttgggcgtgatgtatttacccgtctgatgtacggagcaagagtttcactctgggtaggcggatgtgttgctgcattttcctgtatccttggcacgttcatcggtgtgtatgcaagttatttcaaaattcttgaccagatcctgatgagaatctgtgatggtctgatcgccattccgggaatccttcttgcaatcgccctgatcgcagcacttggtacttccagttggaatgtggtgcttgccctgacgatcgtttatacaccgagtgtggcgcgtactgtccgtgcaagtgcgatggtcatcaaagagcagccgtatgtggaggctgcaaaggtgcaggggttcagtaactttaagattctctggaagctgatccttccgggcgttatttcaccgcttaccgtgcaggcctctttcatttttgcacaggcaatcatttccgaagcatccttaagcttcttaggtgctggtattccggctccggcagcaagctggggaaatatgctgcaggacagtaagctggtattttcaaaggcaccgtggaccatgatctgtcctggtattgcagtagtagtctgtgtactcagtctgaatcttctgggcgacggtctccgggatttccttgatccgagagtaaaaggaggagcgaagaaataatggaaaagcagtgtaatgaatgtaaaaatccaattctggaagttaaagatctgcgggtaaaattctccgttcataagaaatggcttcctgcagtagacggagtaaatctctgcatccagccgggtgagatcatcggagttgtaggagagtccggatccggaaaaagtgtcatgtcacagtccattctccgtcttcgtgatcacgacaccgcggtgcagtacgagggagagatcctgtttgaaaatgaagatctgttaaagcgaccgctttccaagatgagagagatccgtggaaatgatatttctgttattttccaggatccgctgaactctttaagcccggtacataccgttggaaagcagctcagtgaaatcgtgcttcttcataaaaatgtaacaaagtcagaggcaaaggcacgttcgattgagatgctgaagctgaccgggattccgaatccggaagactgcatgaaaaagtatccgtttgaactttctggtggaatgcagcagcgtgtgatgatcgccatggcacttgcctgtgaaccgaagcttctgatcgctgatgagccgacgactgctctggatgtgacgatccaggaacagattctgcatctgatcaaagagctgaatgaaaagcttggtatgtccgtgctctttatcacgcatgacatgggtgcggttgcgcagctctgtcatagtgtgaaggttatgtatctgggacaggtagtagaagatactacgacagaagaactttttgccaatccactgcatccgtatacggaagggcttcttgcctgtatcccgcatcttggagtggagagaggtaaagaacttccaactattccgggaaccgtaccaccgctgaccaagatcccagtcggatgtcatttctgtaccagatgtaaatacgcggatgaccgctgcaagaatacacagccgccgcttgtggaagcaagaaaagggcatctggtaaaatgttggaaatatgcagatcaggcagtgaaagaggaggtatagacagatgagtgaatatttactggaaattaaaaacttaaaaaagtctttccctctgaaaaccggaaagagcagccttttcgggaaaacatcccggatgtgtgcggtagataatatgtccctttccatcaaaaaaggtgagacctacggactggttggggaatccggatgtggaaaatttaccacaggacgagcaattgtaggactgacaaaaccagacagtggctccattctttacgatggaaaggatctttgtaaattaagtgacaaagagttcaaaccacttagaaaagaattgcagatggtattccagaataccctttctgcactgaatccgcgtcagagaatcggaaatatcctggaggatatcctgaagatccacagcaatctggatgcagcagaaagaagagaaaaggtagtagaggttctgaagaaggtaggactttccgaagaccattatttccgttttccgcacgagctttccggcgggcaggtacagcgtcttggtattgcaagtgcccttgttatcggaccaaagctgatcgtctgtgatgaaccggtatctgcgcttgacgtatcgattcaggcacagatcctgaatatgctgatgcagcttcagaaggaactgggactcagccttttatttatttcacacgatatcggtgttatccgttttatctcagatcgtattggggttatgtatctgggaacactggtagaagaaacagataccgaagaattgtttgcaaatccgctccatccgtacacgaagggactttttgcttctgtgccggatccatatattgagcgggatggattttcagagctttccggagaacagccggtcagaaccgaagattttaagggctgtgcgttctctacacgctgtccgcatgcgacagaaaaatgcagacaggaagcaccggttttcagagaagtgaaggcggggcataaagtagcttgtcatatggtagaagaatagagtatgtaagaaaacaccgcaggaaatgggggaatcctgcggtgtttttgtgcggaaggggacgaaaggcaggggaggttgtaagaccgaccggacgaaaagaattgtcataaattccattacgcaaaccattccgatgaacccattggggcgggaatcgtgttcagcagaggcttccacgattcctgggtttcatctccattgcgtaataagtgaatctatgacaaatctttttgtccggtcggtcattctactttgtcggctttgcccttctgagtattccataataaaaagggcagggatttctgctgtgggaagtgggcggattatttatgtagaaataaaagaacgaaagttcagtcaaaagattatatgacacagaaatgaacgaaaatttaagaaaatctaaatagtatttccaactgttttccagtatactgaaactatgattggatatcggaatttaagttatggggcgatggtattgtgcgataacttagagggacaaagtgtatatagaaagtgctgcggcttccttattgaggcaatggagaggaaactcaggaatcgtggaagcctttgctgaacacgattcccgctttcagaggttcctcggaatggtttgccgaagggaagccgcagcactttctatatacactttgtcggactaacttcaacaaacttttacaccttaaaagtagaatgatgaggagggaatgaaaatgaatgtaaatgggaatttcaaagacaatctgatggggaagaaaaaggtgattttcatcatctgccttatttttgcagtcgctctgattgtcgcaatcctgcacatggtttcaggagggggaaaagattccgcgaagaacatcctctacgcggataaggtcagcgtgatcaccggaaacggaagcggaaccgtgaaccgctttgcaggcgttgtggaggcgcaggatactttgaaaatctcactttcagaaggacagaaagtgaaagagattttcgtggaaaaaggtcaggaagtggagcctgggacgaaactctttgaatatgatacagaggagcttgcgatgacactggagcagggaaatctggaactggaaaagataggaaacagtatttccaatctgaattcacagattgcggccttaacgacagagaaaaagaatgcaccggcaggtgagcagctttcttatacaacgcagatccaggagctgcagacgaatgtaaaacaggaagaatataattataaagtaaaagaactggaagtgaaccggacgaagaagagtctggaatcatccacggtgacatccacgattgcaggaattatccaggagatcaatccagatcctggttatgatgattacagtggagaaaagcaggcatttatgagcattctttctaccggaaaataccgaattaagggaaaaatcagtgaacagaatatcggtgagcttcagccgggaatggatgtgacggtgcgggcaaggaataaccaggaggagatctggaagggatctgtggatgtgatcgacacagaaaaaccggagagcagttcacaaagcgagatgtattccggttcggattcttctgcccgggcaactaagtatccattttatgtaacgcttgaaaccagtgatggtctgatgctgggacagcatgtatatatcgagcctggaaccggagtaaatacagagggattacatctgatgactgcttatattgtagatgcagacgggaaagagccttacgtttgggtagcaaataaaaaggacagactggaaaagagaaatgtaaagcttggtgcttatgatgaggagcaggatacatgggaaatcacagaaggactgaaagagacggattacattgtctggccggatggagaatgtaaagaaggagcagccgttcagaagaacgaaaatgtacaggcaggaggcatggaagagggggaataaaggatgacttttcaaaaaagaaataagaaaaaaattcttcagatcgggattgctttggttgtctgtgtatgtttcattggaggcggcattatatttgcaatgaaaaaaagtgaaaaagcggtcaaggtagcaccggtagccagtatgagtaatggtggatggtattcagaatcggatatttatgattatgcgaaggtgcaggcaggtgcgagccaggacatttaccatgatgatacccttacgatcaaggagatttatgtcaaatcaggggatacggtgaagatcggcgatcgtctggttgcttatgataccacgcttgcaggtcttgagcaggaaatgaagcagatggagattcaggggattgaactgaatattcagaatcaaaaggcagaattagaacagttgaaaaatgcaaagattgttgcgtctgttgaaagaagccaggatgaactgcggaaaatgactgcaaaaggaaccagacctggaataatacggactgcggatgcaaagaaaaatgaaggggaaaatccggatacttccgaaaatcctgagcagccggagacaccagaaaatccggaaggaccggaaaaaccatcaatcgggaagccgtttccggaagaactgaaggataagatcatttataaagagattacaaaggacgctgctccttataatgaagatggagatggaacaaaagaaaagccgtatcgctatctttgtgcgccgggagcaacggtaaatgcggagttcatgctgaaaatgctggaagagagggcagtctgtatctttgatgtagtggatcaggagaaggaaccgacgcttcttttatactcctggacgctggacggaaagaccggacaggtgataaagcccgaaaatccggagcagccggggacaccggaagagccgataattccggacgaatcggataaccctggtggatatgaagaaccggatccaggagacgcagatggaatgaccagggaagagcaggcaaagcagatccaggaaaaagaacagaagatcaaggacctggatctggaaaagcgaacagcgcaactggaattgaaaaagctggataaaaaagtaaataatggtgttgtaaaaagtacagtagagggaacggtaaaatctgtacttgacgaagaagaggcaaagctggagaataaaccggttatatctgtgaccggaaaaaatggttgttatgtaatcggagggattgccgaaagcagctatgataaattaaaagagggtatgactgtgatggtgacttcctggaatacggggaacttttatgaggcaacgatcaccagtatcggtaattcaccggttgaaagtatgaagagcagcgagaatcctaatatgtcctactatccgtttactgcagtggttgagaaagatgcagacctttcatctggtgagggtgtcagtatttccgtagacggactttcgggtgacagtgggaattcgatttacctggaacagatgttcataagagaagacggaaaccgctcctatgtatacaagaaaggaaaacatggaaggctggagaagcagtatgtagaggttggaaaaaatatgtacggttccattgaaatcgtttccggacttaccatggaggatgagattgcatttccgtatggaagaaatgtaaaagagggtgcgaagacaaagacagtggagtcactgtatgattataattaatgagggggtgaggagatgcttgaagatatcaggctggcatttcagggaatctggagtcataagctgcggtctgcgctgacgatgcttggtattattatcggaatcggatcgatcattgcaattgtttcgacgatcaaaggaaccaatgagcagatcaagaagaatctggttggcgcgggaaataatgcggtcaatatccagctttatcagggagactggacactggatctgtcttatcaggaggttccggatggaataccggagatttcagatcaggtacttggtgagatccagacactggatgaggtggaaagtgcagccctttatcacagacggaatgaatatgatgctgtatatgcaggcagtcagaagctggcaagctgtaatatttttggaatagattccaattatctggatgcctatggatttcagatcacaaaagggcgtggcttttccaaaaaagattttactgcaaaccgaaaagttgtgctgcttgataaaacgacagccacagctctattcccggatggaaatgtgattggaaagattattgaggttaaaggggagccatttacggtgatcggtatgatggcgagaaaagaaaattcacagccggtgatcaattcaatggaagactattatcgttatgtatccacggatggaagcggaacgatctgtattccggatacactgtggccgattatttatcagtacgatgaaccgcagaatctggttgtccgtgcgacaagcacagatgagatgactgcggcaggagaaaaggcggcagatatcctgaacagttacctgactgtgtctgatgagacgataaagtataaaggggaagatcttctggaacaggcgaaccagatccaggagatcagcagctcgacgaaccagcagctgctctggattgcaagcatttcacttctggttggcgggatcggtgttatgaatattatgctggtgtctgtgacagaaagaacgagagaaatcggtctgaaaaaggcactgggggcaagaaaaagaaggatcctgacgcagtttctgacggaagcggcagtacttacccttcttggaggtctgatcggtgtggcaggagggattgcgcttgcctatattatttccgcagtctcggcagttccggtggcaatcagcggagtgtctattctggtcggagtagtattttccacattgatcggaattattttcggactccttccgtcggtgaaggcggcgaacatgaatccaatcgatgcactgagaagtgagtaggtttatgtagagaagaattatttgtcggatccaagattgcagacaaatagatagtatttgttctgcaggaaagtggcgtgccttactggcacgccatttttaaaaattcttccattgcccttgtctggtagcgaccatttttccagtagaaccggatgtcacggctgctttcgcctgcaggaagcttatagtacaccacatcagaggtaagaggtacttttgagagcatgatatctccgataaaagagatccccatgccggagcaggtgatgttgtaagaagtcatctgctgatccatttccaggatgatatttggttcaaagagattgttctggcagatcatacgggcacgttttccagtgtcgttttccggtttcagcataataaaaggctcacttttaaagcgtgtcagaggaacgggaggacaggattcttccagaaattttttgctcaggatatcttctacaggaagctgataggagcgcagcgtattattgatcgggaatgctcccggaacagcaaggatcaggtgctcttcctgaaatttacggtagccgtagatggtggcatccagaacactgctgtccagcatcagatccagctgcccgtgtcgcagcatacgggcaagattggcagtggtttcttcaaccaggctgatctggatcagaggatatctgcgggcaaaatccgcgatcagcgaaggcaggatccaggaggaaaacaagttgcttcctccgagggtgagtgttcctttttttaggtcgccccagtcgtttgcaaatccttcaaattcattctggatactttttattttttctaccgctttgatatactgtaccccacattcggtaagggaaagtggtttggtactccggtcaaagatcggatatccgatgtgctgctcgacacgctttacgttggcactgagtgaaggctgtgagataaataacttctcagccgccttggaaaagcttttttccagataaacttcatagacatattccattccctgaaacataggtattctcctttgacatagttttaaaattatagttactataaaaatatatgtattagattatattgtaacacagagctataatgaaaacaacaaaggcaatacgccagagaaaaatggaaaatcgagggattttgagatggaaaatggaaaagaaaacaagacaggttatcgtgtagaacaggattcaataggggtaaaagatattccgggagatgtatattacggggtacagtcactgcgtgctgcggagaatttccgtattaccgggctgaatatgcatccggagatcatcaacagtcttgcgtacataaagaaagcatctgcgatcaccaactgcgagagtgggattctggaaaagaaaaaggcaaaagcaatcgtacaggcatgtgatgaaatccttacaggaaaattgcatgagtactttatcgtagatccgatccagggaggtgcgggtacttctctgaacatgaatgcaaacgaagtcattgccaaccgtgcgattgagattcttggcgggaaaaagggagattattcagcagtaaatccgaatgatgatgtaaactgcggacagtccacaaatgatgttattccgacagctggcaagatgacttcactcagacttcttcagaatctgaaaaaagaactgctcagacttcatggagcgctctgcaaaaaggcagaggaatttgaccatgtgatcaaaatgggacgcacccaaatgcaggatgcagttccgatccgtctgggtcaggaatttcaggcatattccgatgccatcatgcgtgatatccaccgtatggataatgcgatggacgagatgcgtaccgtcaacatgggtggaacggcagtcggaaccggaatcaatgcagatgaagcctatgtaagccgcattgttccgaatctttcaaaaatatctgatattcagtttgtccaggcttttgatctgatcgatgcaacccagaacctggatccgtttgtggcagtatccggtgctgtgaaagcgtgtgcagtcacactttccaagattgccaatgacctgcgtctgatgtcatccggaccaagagccggatttggtgagatcaaccttccggcaaagcagaatggttcttcgatcatgccaggaaaagtgaatccggtcatcccggaagtagtgaaccaggtcgcatttaacatcattggaaatgatgtgacgatcacgatggcagcagagggtggacagctggaactgaatgcgtttgaaccgatcgtattctactgtctgttccagtcgatcgatacacttgcatatgcagtgcagacttttattgacaactgtgtgacaggaatcacagccaatgaagagagatgccgtcagctggtagagaacagcatcggcgtaattactgcaatctgcccacatgtaggctatgagaaagcagcggagattgcgaaaaaagcaatgaagaccggggaatccatccgtaatctgatcctcagagaaggtcttttaagtgaaaaagagatggaaaccgttctggatccggtcaatatgacagagccaggtatttcgggaaaagaacttctcagaaaataaagaataaaatttttctaaaagacatgattttctccttttaagggtgtacaatgaaacatacgcgtttcatgagttacaacttaaaaggagaatttttatgcttcaaattcaacatatctgcaaagaataccgtacaggtacgctggtacagaaggcactggatgatgtaagcctgaatttcagggacaatgaatttgttgcgatcctgggaccgagtggttcgggaaagacgacgtttcttaacatcatcggtggactggatcggtacgatagtggtgatctgatcatcaacgggatttctacgaaaaaatataaagacagagactgggattcctatcggaatcatacaattggttttgtatttcagagttataatctgattccacatcagacggtgcttgccaatgtggagctggcgctgactatttctgggattgggaaggaagaacggaaaaagagagcgattgaggctctgaaaaaagttggtcttggggagcagttgcataaaaaaccgagccagatgtcaggcggacagatgcagagggtggcaatcgcccgtgcgctggtcaatgatccggatatcctgcttgctgatgagccgacaggagcgctggatacggcgaccagtgtgcaggttatggaacttttaaaagaagtggcaaaagaccggcttgttgtaatggttacacataacccagagcttgctgaagaatatgcgacccgtatcgtaacgctcaaggacggaaagatccgttcggatacggacgaattttatgtcaatgaagcggtcatgaaggagccggagcataagaatatggggaaagcttccatgtcatttctgacggctctttccctgagctttaataacttaaagacgaagaaagcaaggactcttctgacatcttttgccggttctattggaattatcgggattgcactgatactggcactttccaacggagtcaatgcctacatcaagtcaattgaagaagagactctttccgagtatccgcttcagatccagagtaccggatttgatatgacatcgatgatggtaggcaatatggacagtggttcgggcagttcggataagaaggagacaaaaaaagacggggaagtcaaggttatgcagatgatgaccaatatgttttccacgatggattccaatgacctgaagtctttaaaagaatatctggatggaggaaaaagtggaattgaggactataccagtgccgttgaatattcttataatatttcaccaagaatctatcggcagaacaaggatggttccattcgccaggtgaatccggacaaatcctttgagtcgcttggaatcagctctggcgcaagtaccaacagtctgatgtcatcgatgatgagtacgaatgttttttatgaaatgcctaagacggaggggctttatgagaaccagtatgatgtgaaggcgggacgctggccgcagaattataatgaatgtgtactggtgctgacttcggacggaggcatgagtgattttctcctttatactttgggactgcgggatcagatggaactggacgaaatgatccaggaatttatcaatgaagaagatgtgaacactccggcaaatatcggaacatatacctatgaggatattattggaaaaacttttaaactggtcaatgtgtctgactgctacgaatatgacagccagtacaagatctggaaggataaatccgataataaggaatatatgaagaaactcgtggatcagggcgaagaacttaaaatcgtcggaatcgtacaggcatcggaagatgcaaatgcttccgctctgacaccggggattggctatccgcagagacttactgagcatgtcgcaaaagaggctgcaaaaagtgagattgtaaaggatcagctgaaaaatccgtcaaagaatgtatttactggagaaccgttcgggacgacaaaagagaagaatggactggatgcggacagcctgtttacggtcgatgaggatgcacttcagaaagcatttgttttagacgacagtggattttccggtgatatgttgtcagcagattccctgaatctggaaaatgcattccggatgggtggggattctctggatctgtccgggatgataaatctggatcagatcagtcttgacgtgtccggtatgccacagatgaatcttggcgatatgatcggaagcctggatcttaccgtaaaaccgggtggaatgcagaagttgtctgagagtgttatggaaggttatcaggagtatgtgaaataccatccggaagcagattattcaaatctggcgagagattttatggattacctgatgacggatgaagcgcagaagatcctgaaagataatctgcaggagatcattgagagcaccggtgggtttaagattacaattgatcagatgcaggagcttgtacagcgtgtgatggaaggatatcaaaagtatgcggcggaaaaaggatatacagatccggataaatttggagaatacctggcggagtatttacagaccgaggaagcaaaagagattatgaatgcctggcagcaggagatttttggagatacggtgataaatattacttctgaccagctgaaaaaactgacaaaagaactggcgagtagttatccggcatatgctacggcgaatggaaaagcagatccgaccaaaatgggagattattttctgaactaccttgctacagcagatggaaaacagcgtctgatgaacgggctttccgaggtgatcgatatggatcagctggagagccagttaagtgcgacaatgggaagttacatggcaaaggcaatgggaacttatacccgagcaatttcggatgtgcttgagacacagatcacttcggcaatgaatcagatcgtcattcagattacagaagaaatcgggaacgccatgcaggctgccatgggaaatgtgggaacccagctgcagaacatgcttggaagttcgatgaagattgataccgatgcatttgcaaaggcatttcagatgaatatgacagaagatgatctgaaagagctgatgatatccatgacaatgagcgcgactgcttcctatgacaataatctgcagaagcttggatacgtggattttgcgaacccgagtcagatttccatatatccgacggattttgagagcaaggaaaaagtggtgaaaatcctggattcttataacagccggatggaaaaagaaggaaaagaggaacagatcatcacttataccgatatagtcggaacactgatgtcttccgtgacaaatatcgtggatatcatcagctatgtgctgattgcgtttgtggcgatttcccttgtagtatcttcaattatgatcggggttatcacctacatcagtgtactggaacggaagaaggagattggaatcctgcgcgcgatcggggcatctaagagaaatgtatcgcaggtatttaatgcagaaaccgttatcattggtctgtgtgccggactgatcggaatcggactgtcattgctgcttctgatccctggaaatatgatcatccatgcggtggcagataataacaaaatcaatgcatttttaccagtgcttccggcaattgtgctgattcttttgagtatcgggcttaccctgctcggtggaattattccgtcaaggaaagcagcaaagagcgatccggtgacagcgcttaggacagaataaaaaaagagaatgagggaaaaggaaaatggataaagagaaaaatacaaaagcagtgagtgaggaaaatatttactgtctgaatggaagagtgccggtaaaaaaggcgattccgttcggactacagcatgttctggcaatgtttgtgtcgaatctggcaccggtgctgatcgtgtgcagtgcggcatttgtgagaggatcggagaatcacttaagtgctgcggaaattacgcagcttctgcagtgtgcgatgtttgcagcggggatcgggacctgtctgcagctttacccggtatggaagattggctccaggcttccgatcgttatgggagtcagttttacctttcttggtagtctgctgatgatctgtaccaattcggaacttggatatgaagggatggttggtgcggtgatcgccggaggtatttttgagggactggtaggaatgagtgccaaatactggaaacggttcctgacaccggtagtatcggcatgtgtggtgattgcgattgggctttccctcttgtcggtaggaatggattcctggggcggtggaaacggagcagaagattttggagcgtggtatcatcttctggtcggatttttcacactggttgtgtgtctggctgcccgttatctgttaaaaggtgtatacaagaacctgaacgtactggttggtctggtctgtgggtatcttctgtccattatatttactgtggcagggattgcaccaatggttgatttttcaggaattacaaagacgatcgagcaggttggtgtattcagccttccaaagcttgtattttttacttcccataaaccggtttttgatctgggagcattctttactattgcaattgtattcctggtatcggcagcggagacaacgggtgcaactactgcagtgtgtaccggtgcacttggacgggatatcaagatggaggaactgcaggggtctcttgccgtggatggattttccagtgcgatttcaggatgctttggatgtctgccgcttacttctttcagtcagaatatcgggcttgtcactatgacgggagttatcaaccgttttactattctgatgggggctttgattttgatccttgcttctctgttcccgccgcttggagcttttttcaattcgcttccgcaggcggtacttggaggatgtacggttatgatgttcggatcaatcatgtatgaaggaatcaagatgctcaaagggtgtgtgtttgatgacagaactatgatcatcgtatcgctggcattctgtatcggtgtcggactgacacagacttccggaaactttttttccgcatttccaaaggaggtaggagatatttttaatggaaatgcagttgcaggggtgtttgtggtgtcattgatcttaagtatctgccttccgaagaaaaaaacaacagatttgtaaaatgtgataaaaataagtcaatcagaaggaagagatgaacgaggatgaggacaaaaagaaagatcgaagcgcaggcgtctgaacaattataatcgaaaattgttgagcaaataaggaactggcggcacgataaaaagtgtctccagttcttttttatttcataggaaattccgaaggaacttcctatgaaacaaaaggcactgcgtgccggagatgcgcacttgcacgaagatgaagaatgtcgcaagcgaccgcgctcggcgcgagaatgtgccgaggcacattcttttttagtgtggaagtgaccagtttcagaagcttgttcattatatttgaccagcttggaagtatttgctgcatagagcattggaatcaatgtagcagcgttctggaattgctgcatttcttctggtgaaaatccggttgtgccgcataccagggctttttggtgtttcactgcgagggagagtacctccagactggtttctctggtagaaaaatcgatgatgacatctccggtatcaatgacaattactttcatatgacttgaccggatccgcaccgaatgttcagtaagttatgattccaattgtaagaactaaaaaagcatgctatacttacggcagatgaaaaactgacaggataagacaacaaaggagagacacatgaattctaattttgaatattataaagttttttattatgtggcgaagtatgagaaccttacaaaggcatccagcgttctgaagacgagccagccggcggtgacgagaacgatacacaacctggaaaatgaactgggatgccggttatttaccagaagcaaatccggcatgaagctgacaccggagggaagaaccttttacagctatgtatcggcagggtgcgcccagttttttaaaggggaaaatgatctgagcaatctgatcagtctggagaacgggacaatctatatcagtgcgactgagacagccttgcactgcttcctgttccgggcaatgggagagttcaacagcatttatccgaacgtacatttcaaaatcttaaataacagtaccatggactcggtcaacgcggtaaaagaaggaaaggtagaccttgcatttgtgtcaacggatctgcaggtaaataagccgctcaggatgaagaaactgcgggaataccatgaggtgctgatcggcggcagtcgttacatagaattaaaaggaagaaagatttcattggaggagctttcgacttatccttggattagcctgacttcggaggcactgaccagaaaattcctgaataattattttgcagatcatggtctgcagtttttgccggatatggagcttgcgacgacagacctgatcttgccggcagtccgtcacaatcttggaattggatttgtcccggaagaatttgccgaagaagagaagaaggcagaaaatgtatttgaaatcgaagtggaagagaagcttccgaccagaaatattattctgatctatgatactgagtatcctcagagtattgcatcgaaggagtttcagaagtttctgagcagtcagaagaactaaagaagaaataaattttcaaagtggattgtgcaaatcggtatcctttgtagccgggatgtgtatctgcaaagaaaaatataaggagaatgccccggaattttttatgtgtggatcataaagttccggagcatttttatatttgtaagtataaagttataaagtagaattttggattagaaaacgattgatattatttatgccattcccagtttctgatttcttccagatcctgtccatattcagcgatgtactgcttgtgctcaaccagtttgtcgttcatcttctgaatcaggaatgatcccttattgccaagctgtggcagatgcatgattgcatcttttacaaggttgaaacggtcaatctggttctgtacacgcatgtcaaatggagtagtgatcgtaccttcttcctgatatccatgaacagaaatgttgtggttgtgacgttcgtatgtcagctcatgaatcagtgtcggatatccgtggaatgcaaagataaccggtttatcttttgtgaagattgcatcgtattctgaatcacttaatccgtgtggatgtttgtggtctgattccagtttgaacaggtcaactacattgacaacgcggatcttgagctctggcatttcatcacgaaggatagtaacagcagccataacttcaagagtaggagtgtcaccgcaacaagccataacaacatctggttcttcaccgcagtcattacttgcccattcccagataccgataccctgtgtacaatgctttacagcctgttccatagtcagccactggcagcttggatgtttagacgctacgattgcattgacatagttcttactcttgatgcagtggtcgaagcatgagagtaagcagtttgtatccggtggtaaatacatgcggacaacgtctgcctttttattggcaatgtgatccagaaatcctggatcctgatgtgtaaatccgttatgatcctgttgccatacattagatgtcaggataaagttcagcgaagcgatcggctgtctccatgaaagctggttgcagaccttcagccattttgcatgctgtgctgccatagagtcaacgatacggatgaatgcttcatagcttgcaaagaatccatgacgtcctgtcagaagatatccttccagccatccttcacacatatgttcgcttaacataccgtccatgatacgtccgtctcttgcaaggcagtcatcagtgtcaagcaagtttgcctgccagtcacgtttctgttcttcaaatactttgtacagacggttggacatactttcatctggtccgaagatacggaagttcttactgtcttcatttaatttgaagatgtcgcggatgtatccgccaagttcgatcatatcctgtgcttttgtcttgccaggttctacttcgattccgtatgagcggaaatccggaagacgaaggtctttcagaagaagtccaccatttgcatgcgggtttgcaccaagacgggcatctccctttggagcaagttctgcaagttccggaatcagacgtcctttttcatcgaagagttcttctgcatggtagctttccaaccattctttcagaaggtcaagatgttctggtgattccatagaaagcggtacctgatgtgcacggaaagatccttcaatctgaagtccgtcaacaacctttggtcctgtccatccctttggagtacgaagaacgatcattggccagaacggacgggtaggatcattgttttcacgggcatttttctggattgctttgatttcttcgatgcaggcatccatagtctcagccatttttctgtgcatagtcatcggatcgtcaccttctacgaagtaaggtttccatccgcagcccttgaagaagttttccacttcctcatgagaaatacgtgagaaaatggtcgggttactgatcttgtatccgttcagatgaaggattggaagaacagcaccgtctgtgatagggttcaggaatttgttggactgccatgaagtagcaagcggccctgtttcagcttcaccgtcaccgacaacaactgtagcgataagatctgggttgtccagaacagcaccaaagccgtgagcaattgaatatccaagttctccaccctcattgatagaacctggtgtttctggagcacagtgactcggaactccgcatgggaatgagaactgcttgaacattttcttcatgccttcctcatcctggctgatgttcggataaacttcactataagaaccttccagataagtgttggcgatcaggaagtttccgccatgtcccggaccggaaagaagaatcatatccagatcataacgtttgatgacacggttgcagtgtacatagatgaagttttgtccaggtacggttccccagtgtccgacgatttttttcttgatctgatccatggtcaatggctttttcagaagcggattatcaagaaggtataactgaccggctgacaggtagttggcagcacgccagtaggcattcattttgttgagcagttcatcagataatggctgcttttcaagacataagtttttgtcttccatgtttttacctctctctttctctaattcatcatgtgttaattatttaactgagttcatgatagcattaatgaaacgggacgtaaaatagcaataatgaattatattcatatcaaaaagttatggatggttattagtattatcagtaagactccataaatcgtgataaaagaagtattatttatgtcagtaacaaagattatattcatattcactatattttgtttaggagttcaatgtgctaaggcaaaggaagtggccgacaatcatggataaataaataagcacaatggcaagcacatattgaaagagttcggcgtaatgtgacaaaatgaaaaatagaatggcacgatattttgtgcagaaaggaatgaacgggcgtgaaagattatttacaaggatggaaaaatgtaaagagtggaataagtcacgagatgtaagtgcactcggaaagctaatattgaaattacaggtaagtggatttgaaaagaatgaaaagatagctattgtagatagccaggaactgctaaaacctatggaaaatgaggtttctaatatgtcagaaccagaagataataaaatagcgttgacaaaagatgacgtaatgaggattgttagtgctcattataatgagcagttgactgatggaggatattatattatttacaatgccgaaggcatagaaacagagacaggatttaattttcctttgcattatcaattatcggaggaagaagcacagaaaattgtggatgaaggaggaacgcccagtgcgaataggctggttggataccttgatataaatacggaatcggggatggtaacaccagattttgatgaaccatggaatttatatgattaaaagattaacgtttcaatctagacaatcctgaaattatgaagtataattacaaaagcctgtttttcttggaaaaacggaattttaataacgtattgtttttcgaaaaaagcgagggagattaattatgaagacaacgctgattattatggcagcaggaattggatcaagatttggtaccggcatcaagcagctggctaagatgtccccgaatggagagatcatcatggattattccatctatgatgcaaaagaagcaggatttgacaaggttgtatttattatcagaaaagacattgaagcagaatttcgttctgtaatcggtgaccgtatcggcgatcagattgaagtagaatatgtatatcaggatctggctgatcttccggaaggatttgaagtgccggaagggcgcaccaaaccgtggggcaccggtcaggcagttctttgctgcaaggatgtggtaaaagaaccatttgtgatcatcaatgcggatgattattatggaaaagaagcttttaaactgcttcatgagtatcttgtagagcatgcaggacagtctgataagatgcagatgggaatggctggatttattcttaagaacacagtcagtgagaatggaacggttacccgtggagtatgcgtagtagatgagaacggtatgcttgaacagatccatgagacaaccggaatccgtgtacaggaggatggtgtacactgtgataacgaagatgtgcagaagtggatcacaccggattccaatgtatccatgaatatgtgggcaggttatccggatttcatcaaggttcttgatgagagatttacagaattcttaaaggacgaagcaggagatccgctcaagaaagagtatcttctcccaatcattgtcggagatcttctggaagaaggtaatgtagatgtaaaagttctggaaacccatgataaatggattggtattacttataaagaagacactgaacttgcacaggccgggttcaagaagatgacagaggatggcatttacccggaaaaactctggaaatagaataaggatagaaaaggacaaagaatatggaagaattaaaacagttaggcacacaaagagaagatgaggttgaaatcgatctcggagaaatctttcatttgatgttgagtaaactgtggctgcttatcttgtgttttattgttggggcaacacttgcttttggaggaacaaagtttcttgttacgccaaagtattctgcatcatcgatgatttacattttaactaagactacaagcgttacatctcttgcagacattcagatgggatcacagcttactgctgactttgaaattcttgctacaagccgcccggtagttgaggaagtaattgaaaaactggatttgaattactcttatgaacagcttgtatcaatgatcgcgacagataatcagacagatacccgtatcttaagatttacggtaacggatgaaaatgcaaaagaagcaaaggcgattgcaaatgaacttgcagatgcaacagctgagcgggtggcatatgtaatggcaagcgataaaccgaaggttgttgaagaagcggtggttcctcaaaacccttcttctccgaatacaaagaagaatacattgcttggtgggcttggacttgcatttgtggcagcagcgattattctgatcaaatatcttatggatgatacaattatgacagaagaggatgtcaagaaatatcttggaatccatatgcttgctgcaatcccagaagaaaagaggagataaacttgaaggaaaggacgagaaagattatcgtcgcaggattacttctcgtggcggtttgctgtgcgggatatctgatctggtattacagtatggcagcaaagacaaagcagtcatatgatgatgcaaaaaaactggcaaaagaaaaagtgacgccttcaaaagaggaaaagaaggaggaaccgaagcaggcaaaaccggagattcccattgatttttcggtacttcaggaaaaaaatccggatatttacgcctggatcaagattgatggtacaacggtagattatccgatttgccagaaccttgaggatgacaattattatttgacacatacctgggagagggcagaggcagcagatggagccatttttacacaggcttgtaacagtaagaatttcacggattttaacacggttgtctatggacatcagatgggagaaggtgtggataccatgttccacactctcgaccgttatctggaggaaggatatatcgagaaatatccaacggtagagatctacacgccggagcacattctgacatatcgaattttcgctgctgtgatttatgatgaccgtcatctggtcaattcctttaattacacggtagatagtcagaaacaggaatttctgaattcactttccgatgcaaaagatatgcgaaacaggtacaacaacattgaaaatgtaggaataacagacaggattctttctcttagtacttgcgttaccggagaatcgaaccataggcttttggtggaggcagttctgacaaatgaagaataagaatatagggattattattttggcagtaatttgtgccggattaatggcagcggttgcatttaccttgatcaagggaaaaaacggaactccgggtaagcaggaagcatctgtggattccgaggaggaaacaaaccaatccgggattgttgaggaagatggacaaaaatacaagcgaaataccgatatcaagacaattttatttatgggtgtagataaggatgaaaaagcggatcttggaaataatcccggagaaaacggacagagtgacagtttgaatcttcttgtaattaataaggtagaaaagactgcacagattctgcagatttcaagagattctatgattgatatcgatatttatgatgtgacaggcaataagctgatgacagaagatgggcagattgcccttcagtatgcctatggcgatggtgaggaaagaagctgccagctcacagccggaaaagtatcagagcttttatatggtgtagacgtggattcttatctttcactgactctggatgggcttgtggctgcaacggatgcggtaggtggcattacagttacagtacctgaagattatacggcaattgatccttcctttgaaaagggtgcaactatcacattgaatggtgagctggctgaaaaatacgtccgtaagcgtgatattgaagtgttggacagtaataatcagcgcatggaacgacaatcccagtttatggaagcacttatagaaaaaatgcaagggatcgacgataaaacagaatatctctctttgtatcagaatctggatgagtatatgacaaccaatctgacagcagaagagttggaggaacttgcagactataagatttctgaagatattgtaaaggttccgggagagatcatttcaaaagatggtcacgcccagtatcttgtagataacaaagaattaaaaaaaatagttttgaatttattttacaaattattgtaatagtagtatactgaacaatgatatggcgaatatctaataaactatgtgaggaggtcgaacgatatgaagtcaaaaatcttaaaaacagttggtcttattgcagctatggtagcctgcatcggaatgaccgtatttgctgaaccgagcccggcagcttctacagttgtcacaggtgtcaacagtgctacagataaagacggtaagccagttgaaggtattaccattacattaaaatggcgaaagcaataatgctcatagcccattttgttgctttcttcataaacaaatttcccttcctcatatctttcagcttatgcctctaataacgaaaaataaatttgccattcattgtcaaataaatttcttatttctaaccaaaattatatcataaaaccattaaagtttttagccgaaatcaatatttttttctttgtgtacatcgagctttgtatttagattgctacaatttaaatactcttaataaaagtaattttccttctttaccaaattctgttgatataaacaatatatatttttactatttcttacagttttacccaacctttttataaagttatcgaataatctgctttagtctgtagtatatatttcacagtagaataatctactaaaatatcatcttctcgcaattttcgagttaaaattatatttttcaagcacctgacacgactaagtgccacataggcttgtcccgtcacaaacgtttttggatttagaatgatcctatttaatgtaagtccttgggctttatggatggtcattgcatacgctggaacgattggaaactgataaatataagcctcttcgttatttaatgcatatatttttttacggtgaatattgatgactttcccatttatatcttttatcgttatactattcttttttattttagtaataatccctcgcgttccattcgcataaagcccttccgaattaagaatagtcattaccggcattcctatgtaaactggcaaattaagtttcacagggtatttcgcattggcactagtattgttttgaaaattattttctttatattcaagttcagtatacgtgctatctgttaatttatgctgtgcaacatggtactcattaattgcatccacttcattgcgatacgcagtaagatatacggcaccagtctgttcgtataatgatttaacagaattacagatctcgacatttgtgtttatataagatacacattgcttaaggttcttgccaattgcaatattatttaagatatttatatattcttcattttcagatcttttagatccagttaagtataatactttctctattgacgttttccatgcatcggtttcccaaattttattatttatgaaagtgtttgttttatggagagtagtttcttctttcgtataaaatgcttctaattgcaaaaaatccccagccactattatacgaatattatgttcataattcttttttacataacaaataagattccagattcgagtataaacatctggacgtactacaccaatttcatcgaatataaggacatttatctttaagagtggttcaatatctttataggtaatgggatcagattcgtcccatattttattgctatcaatccgaagacctgaacatatagttttcccatgaacattttctgctgcaattccataagaagccagaatcatatactttatattaaccatatctaaatattccatatagtaatgtaaccatgtcgattttccagctccggcgccaccagtaagccataaattctcttttccatttaacaattctattatttttttaattttctcctcgcaaattagacatccggtttctttctgcccctcctccttgtctcctactttaacggaggatttaccgtctgtcttttcttttttataacgcaattcaatggtcacgtcttctaacttctgtgtgcgggaagcatctaaatttaattttttcaaacgatttcgtaccgttttttcagaacaatatgcatatccttctttttttaattgttcagcaattttgggggaagacattttttggcatagccatagttctacaatcctttcatctctcttcagagaatttaattggttggcagaatatttttggtctctgagataggttttcaacattccataagaaattgcttcttcttgagttataggtaaaaaatcatttacaagcgttacctctgaaaataaatacgttccatctccgtgcattctatcagttgttgcccagtttttggatccatttttttcacaatgcttttgaactctggaaacctgttcgtaaagttcacttatactcaatggctctaaaaaggtattattgatgttttcaacataatttatagcttcttcgacagtatatacatatcttgcaaggctgtatgccgcaaaaattaatttgtgccgtccagaaccatcaatcatatttttatctaatgcaattttgggaattattttcaatcgactttctgcatattttttaattccaggaattgctggtattattgcattaccttcttttgctatatcaaaaagatttctattattttccgcagattgacaactttttttatttgtagtattttttctagatggttgatttgaacgttcaattcttttaaattctagtttttcactcaaatcttttaatatgtattttgtctgcgaattatatacatataattctgcatatctgtttgctttcagattaatagttcctggtaatctggtaacacgagcgaaatcagatacattatctatatcaataactcctttccagggcgcaaatgtatcttttaattttttcagtgcgtgcttatataaagaagtatgtaattcacattctgcggtttctgttttgtcaaaattataagtagctattggtgcttgatatttataataccaagcgaatccacgtcctgttaatgtaattaaagttggatccggaaatatagaatacataattgatattacataagcaattacttcatctgctaattgcgctttatatgggagtaaattgtgcaatatatctatatcaaaatgcatttcattaattccgatacaattttctttatttctttgcaattgccctcttttattctttttttcgcccattggatttacacaaatataactatcatttgtatctttccaaatcttttttaaataatctgtgtttgcaatgctgccaaaatatacccaggtattgttatcccaaggcatttttctctttttctcatttgtcttttgatcataataaaatgcatcttctggatttttccattttttctttcgtgggaaagaataaaatcctgctgctccttctgtaagtaaccttataaaaagatctaactgatttgaatgagattttttacgatattttgaggtgagatttacaggaacaattttttctgtttttgcccatttaataaattcttttgcgagagactctaaatcattattttttgtatccttttgcatatgatatatatcctttcttaatagtgcaaaaggaatatggaagattttaaaaaaaagattcagaaaaaaattttgcttcatattgcttttaatagtttaactatgttattctaataatcagaaatattatttaaaaatttggctaaaaataagtcattattggaaccaggttccaaaaataggcacaaaaaagaggctaatgctctacgataaattaatttcgttgagcattagcctcttttttgtcgaacatctggtaaaagcagcagctgtagttcactacagctgccccataaaaattatctacttctgtttttcggaataaaatccttaccaccagaagaagttgcataatctggaaacaaatcattaaaagtatattttaaattatttccagattcgaaagtccatgctaaacaaagatagagatatgccatggattcttttaaattgtacaaatttggcaatattgacattttaaccgaatatgtattctgcttagatgctacttccgcttcaacgccaagagctgcaaaaatcgcttcatgaataattggcaatacgcgcagattttcggctactgcatctaatttttcaccatggaatgaaaaagtaattttaatgctgttgtcataataagaacttacaaccataaggattcacctctctttcaatttggagttacttatagtttaaagaatcttatatattttcgttttttacagatggattctaaatggaatcatttgccgagaaaacaatggaatccaatctactgttttcgtgagtttcatctttttctagaaaattacaataaatttccatgatggataatacggaagaataatgaagttggttcgccataaatccaaacaaaactgttttcagcatgctgaccgggtcatacctgagtcttcctgtatcatgttgaggaatatttttcagatatttctccagttcgatttctcccataaatctatcaaaagtcagcactggatcacagacgtccaaataatcttgaattagcattggcaaaactgcctgttttgggttagaatagattatgttattaattttcattgcaagttaattataacagaaagaaagaccttgagttcattataaactcttggtctttcttttttggtggactattcttttttcacagccccttggcaaaggtgtgtcaagagaaacaatcctgcttgtatagaaatttgatttatggtatgataactttcatagattaaacggaataaccagtcgaataatatctggagaaatcaatgtatgaagagtaggagaataaatataatgatttctctgattaaagttaaggtagtgggaggaaggaaaaatgcagacttttgcgaatacaggaataaaaacggaagttatagacgaaattatttcatttgcaaaaaaacatgatatacattgtgtgattctttttggatccagagcgaggggagacttcaagaggacgagcgatattgatattgcggcaagtggtggtgattttgatcgttttgcattagatgttgatgaagagacatccacgttgctggaatttgacattgtggacctggatagagatatgcaagacgtcttacgagaatcgatacggagagaggggaaaattctttttgaaaaagtatgaaaatttttgtgtgtcattggaaaatatgaaggatatttataattacgaagaaccgtatgataatgtcgttctaactggtttggttggattatatgaaattacatttgagcagtcatggaagatgatgaaagaaataatgtaacacattcttataaccgaaagattgcaatggggattattacgcaggcaaaacagaagttttataaaatgttctgtgaattaaaagaagaaattgacaggaattggatatagtagtcaggagcataaaatgaatacaaatgaaatcaagattcgcccggcaaccgaagcggacgcagcagaaattttaaatatctatgcaccctatataacggacacagcaattacatttgaatatgatgttccgacactggaagagtttacgggacggattcgtcacacactggagaaatatccgtatctggtggcagtaagagacagcgagattatcggttatgcatatgcaggagctttttatgggcgggctgcatatgactggtcggcagaaactacgatttatgtaaagaagggttgcaggcacagtggtgttggaaaactgctttatcaggcacttgaaattgcactgaaagcacagaatatcatcaatttatatgcatgcattggatatccggaagaagacgatgaatatctgacaaagaacagcaagcagttccatgaacatctgggataccgtttgatcggagaattccggaagtgtggttataaatttgggcgttggtaccatatggtctggatggagaagatgataggagaacatccggagaaaccggagcaggtaaagagattttcagaaatatagtgatagaaattaaaaaacgggagaatgctgtttgaaaatgcattctcccgtttctcaatattgttatgagagcatctcttcgatcttcgcctgcatttcagcgacggtatgctttcgtgaccgggcacattcctgtgcctgacagccgcagatcaaacatttgcggtagacgccgcgggagagtttttctccgtctgttccaatcacatccatatcaaaaagacgtccgaagggatggttttcttcgagttctgttgttagttctttaattttatctgccggatagtcgactgtaagaataatttcatttccagtcttctcatcaaactcagtttgggtaagaatcggaacgttctctttttgtaatacggcaaaaagtgcttcctttccggaaaggaatgcttttttgatctgttcattcgtctttataggtcccggaatattcatgcagaatgaaatcactgggcaatgatatctttgaatatattcattttgtatattaacgcggcgctcgcggcaggcgagcatgtcggttaatactactttctgtcctttcatagcagatcctcctaataatgaataacattttcttgttgtctgatccgttcgattacaggaattgcttccggacttttgaaataatccagtgtggtttgcggtaccagcttcgaaagggtatcatagtcaccattttgcagggcaagacgtacattggaagcgctgatcggtgtatcctcacaggtctttcttgggacaacgatacattcgatgccctgttccggtaatttttcagacatgatccggttatagattccggtaaccaggctagtaggctcttcccctacgtaacggcgagtgataccgagcacctttgcaatctgcgtaaataccgtcaggtccagcatggcgtggctttcaatcactgcattttcatctttctggaaatagcttggaaaagtagcattgctgataatatatggaccactgtcgtgataacagatgtttttcaagtgtgctgttcctttcatgacgagttgttttctgatcttgaatggaaccaggctggcatcttcactgacaatgaagagatgaagcagatcattttcagcagccgctttttctacaagatactggtgtccgagggtaaacgggttggcgttcatgacgagagcagcaatctttctggtgggagtctcagcagtcaatccttctggaagtgcatcttttgcaaaagtacgcagataattctgaaatccggtttttcggttttccatgaagacaatctgtccatcgatccgggcaatttcatagaatccaagatcaccgaagaacttggcagaattacatttggtgtaaagaaaaaggtgtgtattccctcttgaaaactgaaattcaatcagatgagagacgatggaattcatcagtccttctccctgatgttcatggcttacggcaaaacatcgtaaggtgttgccaaaacagcttcctgttgcgataatgtgcatctcatcgtcatacatgccgcaggtgtaatccaggttagcatctctgcggatctcttctgagataaggagcgcgtccacttcatcgttggctcgcttgtcggaaggatagatttgagaaatataataatctgacatagataaattcctttctgcacagtagcccaaaatatttgatgaaattattttaacatgtgtatagaaaatgtaaagaggagcatggattcaagaaagaaatcaggcattattcttaaaaaaatacaaattgaatttatgtcatattgatatgatcacaatatgaattatgtaatttactaataaccaggataactctataatatagtcggataaaaaataatcgtatgatttatagtaaaggaaggatagatatggcaaccattttcccaagagaagaaaaagccgagatgttatttgacaagattcttgcaaacccggaggcatgcaggcgactgaaaagaactttttatgatgccattgattccggagatgagtttgtgacagaaaatcttcccgcaaagcagttcaccgctgcattattcgatgcatatgaaaataaagatctgactgcatttctcatggctgtgtgccaaaacagtatgttcgatcttttaagaaatgcttttctgataccgtttaaatttaatgcggatggacagacaaatcctatttttttgacagatgaagagggaaagcttctggaaaatcttccgattcatgtaaaggaaaaagaatatgaaaaatttcgaaaagtttatcagaagcgtgataaagtaaaaatgtatctggcacatggatataagaaaaggcattgttatgattcagaaacaatggaaacacaggaatataagatgggagagcatgacggagtacttctgatctatgaacttccggataccgtaaaagaaaaaaagacggaggctgaagcttatgcagctgtgtgggatattatgatggaacttcaaaaggaactgccaaattctgtggtatattacggacaggatttcttgcaggaagaaggaaaaagatttgatgaaatgggggtttttcttccgctggaacacttttctgacagactggaaaggcatatagaaaaagcggatcaaattgtatatggtaaataaaaagatgcatctggttgaaaaaagatcagatgcatctttttatttaaaattcttttttacgtgcaataacggaatgtcttgtccgtcagaattcttgcaaagataagtccaagaggcaaggcaagaatgataagtattgcagctgcaaaccaggatgcagaggtttgcagagacatcactccaagattatagattgcccggtaaagataaagtcccggtaccatgatgacaatagaaggtacagtcagagaaattctcgggtaaccgattttgctttttaatacagaagccagaattccggcagtcagggcaccgataaaagctgcggctgcaggaggcagggaggccaagtctaccagttcaagacggagtgtattggcaattgctccaatgataccggctgtggcagagagttctttaggactgttgaacataacagaaaagccgaacaccccgcagaagctggcgagaagccggaatagtatatgttgccagagtgtgagagaaagaggtgggaaatcacttggctttaaatgaaggataagtgccatgatccaggcggtcaaggttgcgacaagaatgatgatcattgcgtaagcaagtcgttccaggccggatcgcatatccagttttgcaaggtcgattccgctggtgataaatggaaaaccgggaatgatgaaaagcatagagcatatatatccggcttcatgagcaagagaaatgccgaacaacagttcagttgtttttaaaagtgcagcatagataaggcaggcagcagcaacagaggcagtaatgcctaagaataatgtgaaatgatgcttagtcagtttacatcttacaaagttgccgataccggcaccgaaaaaagcaagaagcatttctaccggtccgccaccaaggagaaaggtaaatgccccacaggcaaatgctgcggcaaatccgagtgcaactggagagtaaagaccatggatccgttcaatctcatccagataagaatgaatctgttcaccggaaagatatttttcctttgttgggaaatcgttgatgaagttttccaatcggttcaatttcgaagtattaacaccggtattggtcagacacagcgactgtgaaaaacagttttcaccgtcaaaacaggtgtattcaatggacatcaggccgatgtcggcggtacaggtgattcccagttctctggaaagggtattcatggagcttcgaacacgccatgctccggttccacaggaaagaagcatcatgccacatctaccgacaacggaggctttttcaattagcccggcctttgtgataggaatggtatcttctttattcagtgcataatcatgccatagaatgtccatatgatttttttctattatgccttgctgcataaatttcacttccttttgctataccaataatacatgaacaatatattaaatatgtattattgatattgatttatcataataaagtataatcatcgaaatgcaaaagtcaatagaagagttgagaaattctgaaaaaggatacggatatgccaatgtggatttaaaaacatgaccgaggcaatgtgcataaaatgagaagccattttttgtctaatgtgtataagaaaaagtatgtagaaaacaccggcagtttttaaagtaataaatgctaataaaaaatgctaataagcaagaaagcctgtttttcttgacactcattatgttaggtgttacggttattgagagttaagaaaactccgtttatttattaagaaaatgaatcaatgaggtgtaagaacatgcaggaattaaaaccgatcaaagaaggtaaagtacgtgagatttatgacaatggcgacagcctgatcatggttgcaacagaccgtatcagctgctttgacgtaattcttaacaatgaagtgactaagaaaggtactgttctgacacagatgtcaaaattctggtttgatatgacagaagatattcttccgaaccatatgatttctgtagatacaaaagagatgccggaattcttccaacaggagaaatatgaagggaaatccatgatgtgtaaaaagctcaacatgcttccgatcgaatgtatcgttcgtggttatatcacaggaagcggctggaagagctatcaggaaaatggcacagtatgtggaattaaacttccggaaggattaaaagaatctgacaaactgccagaaccgatttacacaccatctacaaaagctgagatcggtgatcatgatgaaaatatctcttatgaacagagtgtagatcacctggaaaaatattttccgggaagaggaaaagaattagctgaaaagcttcgtgataacaccattgctctttacaaaaaatgtgcagaatatgcactcagcaaaggaattatcattgcagataccaaatttgaatttggtcttgatgaagaaggcaatatggtgatcggtgatgagatgctgacaccggacagttcaagattctggccggcggacggatatgaaccgggacacggacagccgtcttttgacaaacagtttgcacgtgactggcttacagctaatccagataacaactggacacttccacaggaaatcgtggacaaaacaattgaaaaatatctgcaggcatatgagatgcttactggagaaaaacttgcataattattgcatttcatatcataagaataaaaatacaaaaggatcggcttttaattgccggtccttttattaactgctattataataataggaaaatatcaatgagaaaggaagaagcttatgaaacgaccatttaagaggattttatacggcggagattataacccgaaccagtggggaaaagaggtctggaaagaagatatgcgcattttcaaagatgcccgtatcaatagtgcaacgattaatgtattttcctgggcaaagatccagccatcggaagatacttacaattttacagaactggatgaagtgattgctatgctcagccaggagaattacgatatcgtgcttgctacatcaacagcagcgctgccggcatggatggtaaagcgttatccggaggtcgcaaggactgattatgagggaagacatcacaaattcggacagcgtcataatgcttgcccgaattcccttgtgtttcagaagtttgcatcccgtctggccggaaagcttgcagagcgttacgggaacaatccacatgtaacctgctggcatatcagcaacgagtatggtggagaatgctactgcgaaaattgtgagaaagctttccgagtctggctgcgtgaaaaatatcagacactggatgaactgaacaaagcatggaataccgagttctggggacatacgatttatgactgggatgaagtagtacttccagatgctcttggtgacgggattgaagatgcggcagaaccgcatatgacagcttttgccggactatcgattgattattgtcgctttaattcagacggaatgctgaataacttcaagatggaaaaagaagcaatccgtaaatttgacaaagagacaccgatcactacaaatatgatgggaacctttaaaggacttgattatttcaaatgggcaaaggaaatggatgtgatctcctgggataattatccttcttataatacaccatggagtctggtcgcaatgaagcatgatttgatgcgtggactcaaagatcagccgtttatgctgatggaacagacaccgagccaacagaactggcagccatataactcacttaaacgtccgggtcagatgcgcgcgcagagctatcaaactatggcgcacggtgcggatacaatccagttctttcagttgcgccgaagtgtaggcggatgtgagaagttccacggagcagtcattgctcatgccggaacggaaaatacaagagtgttccgcgaagtgaaacagttaggtgaagaattggaaaaactgagtaatgtgattccgggaactgttaatgaagcagaggtcggtgtaatctttgactgggataactattgggcattggaatacacaagtggaccatccatcagtctcaaatatgtggatcagatccatcggtattaccgctatttctatgatcataatatgggggttacaatgattccggtagatgcagatttttctaaatataagatgatcgtagcaccggttctttatatggtaaaaccggggatgaaggaagcactggagaaatatgtaaaaaatggcggtattctggtgacgacttatatgagtggtatcgttggtgagtcggacaatgtatatctgggcggatatccgggaccattaaaagagatggccggtatctgggtagaagaaattgatgctcttgcgccggaacagtataatatagtaacttttaaggacggaagccagagtaaatgtaagatcgtctgtgatctgatgcatctggaaggtgcggaggcactgggtgaatatgccgaagatttctatgcaggcatgccggcagtgaccagacatgattatggaaaaggaaaattatattatattggaagctgtatggaagttgttggaacagataagattcttactatggcagcagaagatgccagggtaaatccggttgcagaaaatggtaacggactggagattgtaaaacgtaacggagaagagaagagtttctactttgtgatgaactttaaggatgaagatctgaaaattccggaagaatttgcaggaaagatggatctattaagtggaaatgctgtagaaaagggagaaatgcttccgaagtttggggtgaagattctagaagaataaaaaatttgagagaaatataaaaagaaacaggaagttcagatagatgcaaaagcaaagctgtctgggatttctgtttctttttatttaacaggaagatgtcaggagagatgctgtttggattgtacaaaaataaaaacatagttttcatacttaacatatatgttataagacgatataattcaaaacaacaaaaacatattaaataaataggtaaataaggaaaagaaatatctttccagtggaatttattcggatgagacgaagagatagaagaagagaggatttttcatgcggctgaaaaatcctctctttttctattcttcaattacctggatttccagaaaatcaaaatcaatcgaatccacaaaactgtcctggtaaaatcttgctttggaatgccgcttgaattcgttgatattcacatccagccagatcggtttgctgagatcaaattcatagcagatctcatccagagcattgaaaatcttgtgggttcttgtatcgtcactgtcatcacagatggtggtatctttgatcatatgattgtctttaaattcttttccccataagcggaacatggtaaaatcctccttataataaatatgaaaaatgccggtcaggcgaagaatgtttttgtatcaagtgattttcagtatagcggatttaggggagaaagtaaaggagacagattttattctatgattctctgatatgatgtgctatattgatactaaagtttatgaaagaaagagaatcattctcaataacatggaataggatagagaaaaaagacagggaatcagaaaaatgtctggaataaaacgagaaactataatccgggttatactgggaatctgtatgatatttgtatcgattggtatgatatatggtaagtccaaagccgggaacgcagatgaaaaaggcagaacctatatagaagaatcagaaaaaactgcaaagcagaagaacacagagaaaagcaggaaagacagcacggaatcaacaaagacagacaacacaattaaagcccagatgacagaagcgcagcagctatcagacaccgaagcaaaaggcattgccgaggctgaagcggtagaggcatccatccagccgggacagtatccggtgatggggatcagcagtatccgcgcatggcaattagtaaattattttaaagtgcatggaagcacttatccggcagaagttttgacgcagggaggtgcaccggatattgagacatttgcacagatgtattatgaagaagccacggcagaaggcgtccgtccggaggttgcatttgcacaggcgatgaaggagacaggctggctgcagtatggtggggatatgcagatcacccagtataattttgccgggatcgggacgacgggaggaggcgtaccggggaattcctacccggatgtcagaaccgggatccgggcacagatccagcatctgaaagcttatgcgacagacgaagcacttgtcaaggaatgtgtagatgatcgttactcttacgtgacaaaggggagcgcaccgtatgtagagtggctggggcagaaagaaaatccggaagggtatggctgggcaacgggtgaacgttatggatacgacattgtagaaatgattcatgcaatgcgaaaataaaagaaatgtgtcagattgagattatctaatttattaaaatactatgaagcttgtccgggctgtatagatttcaaagagaaaaaatggtatactgattttactttcgggacgaaaaagggagatagattccggagggaagtatacataaaaaggggagattacatgcagtcagcaatgaagtattacgatgacgtagacagctggaagaccgtcatgtttctttacaattccgcattgaaagaagtagggacgaagctggagatactgaacgatgaatttcaacatgtacacagatataatccgatcgagcatattaagaccaggatcaaatccgcagaaagtattgtgaaaaagctgaagcggtacggatatgagacaagtattgagaatatggtacgctatgtcaatgatatcgcaggagtccgtctgatctgttcgtttacatccgatatttaccggcttgcggagatgatcgggaatcagagtgacttaaaggttctgtcgatcaaagactatatcaagaatccgaaggaaagtggatacaagagctaccacatgctggtgtctgttccgatctttctgtcggacagtgtggtggatacgaaggtcgagatccagatcaggacaattgcgatggatttctgggcgagtctggagcataagatttattacaagtttgaaggacaggcaccggagtatatcagccgggaactaaaggaatgtgcggatatggtatcggcactggatgacaagatgctgtcactgaatgaagcaattctggaatgtctgaaagaaggcggtgagaagccggttccggagaaaacagaagaagtggatgcggagatcattgagaatcctatgatccgataaagaaacacaagaaagtaattataagaaagcaggagcagtcaattgattgttgaggagtatactcaacgttaactgactgttcctgcttttttgacaccgaacagaaaaaaatcatatttaacaaaaactttacacagccaggatttcagattttacaaccattttatatgatagagaccgtgaagaaaagaaaaaataaaaacacataaaacggaggattttagtattatgaaattcagaaaattaatggcagtagcacttgtagcagcaatggcagcaacaatggcagttggatgcggaggatcatcatctgacaagagcgcagagggcagtacggataacagcagcgcagatagcggaagtgattttgatacatcaaatgatatcacaatcgtatcccgtgaagatggatccggtacaagaggagctttcattgagctgttcggaatagaagaaaaacagtcagacggaacgaaagtagatatgacaacaacagatgcgcagattacaaataatacatcggtaatgcttacaactgtagcaggtgacgaatatgcaatcggttatgtatcactcggatctttaaatgacagcgtaaaggctctgaagattgacggagcagaagccacagcagacaatatcgaaaatggttcttacaaagtgtcaagacctttcaatattgcagtgaagaaagatcttgataatgaagttgcaaaagattttatggcatatattatgagtacagaaggacaggaaattgtatcaaatgaaaaatacattccggtatcggatgtagaagcttatgcaggatcaaaaccatctggaaaatgtgtagtaggtggatcttcttctgtatcaccgctgatggaaaaactgattgaagcatataagaaagtaaacccaaatgcagacattgagcttcagacttcagattctacaacaggtatgacatctacgatcgaaggaagctatgacatcggtatggcatccagagaactgaaagatgacgaagcttcagaacttgaagcaacagtaatcgcaacagatggtattgcagtgatcgtaaataaagctaacacggcagatgagctttcagcagatcaggtaaaatcaatctatgttggggatgttacaacatgggatgaagtttccaaataaataaaagaggaaattaaagaatggaatcaaaagcatggactgaaaaagtcatgcagggagtgttcttcattgccgcctgcacttcggtgctggcggtagctctcatttgcatcttcttgtttgcaaatggaatccctgcaatcagacagataggatttgtaaaatttataaccggtgatatctggcgtccgggaaatgaactttttggtatttttccgatgatcatcggaagtatctatgtgacggcaggagcaattatatttggtgtgccgatcggaattctgacttcggtatttatggctatgtattgcccgaagaaaatttacagaccgttaaaagcagcaactgaactgcttgcgggaattccgtcagttgtatatggtttcttcggcatggtgatcgtagttccgatcattcgggacttcggaagaactttaaagatgatgggactggttgaaaaatccggagatggaaaaggaatcctgactacatcaattgtacttggtatgatgatccttccaacgatcatcgggacaacagaaagtgcaatgcgtgcagtaccaccacagtactatgaaggctcgctggcacttggagcaacccaggaaagaagtattttcaaagttgtgattccggcggcaaagtccggtgtgatcacaggaatcgtacttggaatcggacgtgcgatcggtgagaccatggcagttattatgatcgcagggaatcagcctagactggtcaataatattctgctaggtgtccgtactctgactggtaatattgtaattgagatgggatacgcgaccggacttcatagggaagcgctgattgccacaggagttgtactttttgtatttatcctgattatcaattttagtgttgcgctgcttaagaggaggggtgaacatgagtgatcagacgaaaaaacctgtttatatcaaccgggaaaattttacagataagataaaaagctatctgagacatccgggatccatgattttgatgtttcttgtgatgcttgcgacatttatcacgtttgcattgctcctgttcctgattttttatattttgatcaatggaattccgtatattaaaccgtcattattttcattacattatacatcggacaatgcatctgttataccggcattgatcaatacggttgttatgacactgctttcgcttttgatcgcagtaccatttggtattttttcagcaatctttcttgtggaatacgcaggaaaggggaataaatttatcgaagtgatccgcctgacgacggagactctttcgggcattccgtctatcgtatatggtctgtttggtatgctgttctttgtaaatacgctgaaatggggattttccgttctggcaggtgcatttactttatcgatcatgattcttccgctgatcatgcgccagacagaagaagcacttaaagcagttccggattcttacagagaaggaagctttggacttggagccggaaagctccgtactgtattccgtatcgtgcttccatcggcagttcctggaatccttgcgggtgtgatccttgccattggacgtatcgtaggagagacggcagcactgatttatacagcaggaacggttgcacaggtgccaaagaatgtacttggttccggtcggacactggcaatccatatgtatatgctgtcaagcgaagggctgtatatgaaccaggcgtatgcgacagctgttattttgcttgtactggttgttgcgatcaacaccctttccggtgtggttgcgaagaaactgacgaaagcatagagaggaaaagaaaatgtcaaagataagtgtaaaaaatcttgatttatattatggcgatttcaaggcactgaaaaacattaaccttgagatcgagccaaataagatcaccgcgtttatcggaccgagtggttgtggtaaatccacacttctcaagtcgatcaaccgtatgaatgatctggtagaaggatgccggattgacggcgaaatccttctggacggacagaatatttttaaaggaatggacgtaaatgtcctgagaaaaagagtcggaatggtattccagaaaccaaatccattcccgatgagtatttatgataatattgcttacggaccgagaacgcatggaatccgttcaaaggcaaaactggatgatattgtagaaaaatcactgcgtaatgcagctatctgggacgagtgtaaggaccgtctgaaaaagagtgcacttggcatgtccggtggacagcagcagagactttgcattgcacgtgcacttgcagtagaaccggaagtacttctgatggatgaaccgacttccgcactggatccgatctcaacatccaagatagaagaccttgcgatggaactgaaaaaagattatactatcgttatggtaacacataatatgcagcaggcagtccgagtgtcggacaataccgcatttttccttcttggagaagttgtagaatataatgatactgaaaaattattctcgattccgtccgataagaggacagaagattatattacagggaggtttggttaaatgcggaacagatttgacagacagctggaagaacttaatgagatgcttatccatatgggagaactttgcgagacggcaatcgaggaagcaacaggagctctggaaggacatgatattgccagagcaaaggctgtcattacagcagacagcgagatcgatcagatggaaaaagaaattgaaaatctctgcctgaagcttttgcttcagcaacagccggtagcgcgggatctgcgaaggatctcggcatcacttaagatgatcacggatatggaacgtatcggagatcagactgcggatattgcagatattgtgatcgcaacaaaatcaacagaggaaaagaatctgaaggatattaaccggatggcagaggcgactgtaaagatggtaagagacagtgtatctgcctatgtacagaaagatctggagcttgcaagaaaagtcatggatgcagatgatgaggtagatgatctttttgatctggtaaaaggagatctgataaaatttatttccgatcacaaaggaagtgccggagatgaggcgatcgacctgatcatgatcgcaaaatatctggagaggatcggagatcatgcaacaaatattgcagagtgggttgaattttcaattacaggtattcatgcaggcggaactgcaatctaaaagaaattaaaggagaacgagaatgattttttgtgtggaggatgaagcgaacatccgggaattagtagtatatacacttgagactacgggatttgaggcccgtggatttgaagaaggcacatcattctttgaagctctggcagaggaactgccagagctgattttgcttgatatcatgctccctggagaagatggaatggagatcctgaagaagctgaagacttccgggagaaccaaagatattccggtcatcatggttacggcaaagggtgcagaatatgacaaggtcatgggactggatgcgggagcagatgattatgtgaccaaaccatttggaatgatggaactggtatccagaatccgtgcagtactcagacggacatcgaaaaaagaagaggatgatacctatgtgctgggtgagatccgcatggaccgtaaaaagcatgaagtaacggtagcgggagaaccggtagcattaacattgaaagaatatgagctgttgagaaaacttatggagaatcagaatattgttctgacaagagataaattactggaagaaatctggggatatgattttgacggtgagaccagaacggtagatgtccatgtaagaaccctgcgccagaagctgggacaggcaggagaatatattgagactgtccgtggagttggataccgtataggagagatcgatgcgaaatagaatccagaaaagtatgatttttgtggttacgatgtcactactgatctcgtatattctggttactctggttatttaccggcaggcgctggatatccggcgcagtgaactggttcaggaggcaggatatatccgggcggcaatagaaatatccggagaagaatattttggcaccatggataaggtcagtaagcgcaccagggtaacatggatcgataaagacggaaaagtactttatgataccggaaatgatcaggaaacgctggcaaaccacaaatcaagaaaagaattcaaagaggcattggcaaatggcagtgggcaggatatccgtatgtcagacagcaaaggacaggagatgtactattatgcgttgaagatggatgatagctctgtcctgcgtgtgtcaagaggcatggatacggtctggaatacagcatttatgatcttaccgtatatgattgcgatcggggtcatgatggcatgtgttgcatggtttatgacaaggcatcaggtgaaaaggctgattgcaccgattaacaatctggatctggaagaaccactggaaaatgatgtatatgaagagttgcatccgctgcttgaaagaattgacaggcagaataaagaaaaagcagcaattgaacagatgaggagagaattctctgcaaatgtttcccatgagctgaagactcctctgacctcgatttcgggatatgcagaaattatgatgaacggtcttgtaaaatcggaagatatgcagggattcagtgaacggatctataaagaggcaagcaggatgatcaccctggtcggtgatattatcaagctgtcaaagctggatgagggcagtgtggagcttgaaaaagagaatgtggatctgtatcagatgacaagggagattgtgagccgtctggcacttcaggcagaaaaacgcagaatacaggttgaagtggtaggagaacatgtggaatgttttggaatccgtcagatcctggatgagatgatctacaacatctgtgaaaatgcgatcaaatacaataaagaaaatggaaaagtaaatatctgggttggaaatacactgaatgggaaaaaagtcattgtccaggataccggaatcggaatcccaaaagagcatcaggatcgtatttttgagcgtttttaccgggtggataagagccattccagagagaccggtggaacaggtctgggtctttcaattgtaaagcatggagcacttttgcataacgcagaaatccatgtggaaagtgaagaaggaaaaggtacaaaaatggagcttatttttcattgttaaaaaactgtttacaattgggaaattaaatgtataatgtatagaaaaaagctatgaaatattatagcttttttctattttatatcaaaaacagaatcatgtataataaagagtaatatgactaaaattaaaaaatggttgaattcggtatggaagagtgccggatacaatctgtgtagagattcacatggaaaatgagaggcaactatggaagaacagaagcagagtacgagcagcaattattttaaaggattatccagaagggattatatccagaaagcacatgagatcattcagcaagaagggattcaggcagtatctatccgcaggattgctaaggagatggggtgctcatcagcaagtctgtacaggtactttgataatgtgtctgaacttttatactatgcagaactcagaattttaaccggttacatagacaggctgaatgaggctgagaaatcctggaagaatatgtggcaggtatatgtaggtgtgtgggattgttatgcaacggaggcatttcataatccggaagcatataatctgttattttttgagtataacaatgtaaaactcaaagaagcaatgcgggaatattatgaaatgtttccggaagatattgtaaatgttaaccgctttttctacaatatgcttcagacaccaagctttctggcacgtgattttgagatgtgcaagcggtgtatcaatgttggtggtattacatatgacaatgcagtaaaattaaaccggatggtgtgcatgctctttgaaggctacttcaaagatgtatatgaaaacgggataggggaagagcagattccggaacgtgtaaaactgatggtagatgatgtagatacgatcgttatggctcttgccaacaatctgaaaggctataaaggataccgtaaataaggaaaaaacgccggtttttggttatttttaaatacaatccttgttaaaaatttaattaaattgcaatccccaaaaaacgtggtaaagtatatgtgaaagtatcgaacacacgaaataaggaggcaatttaatggacaatatgaaaggcttcggcatgatgattcaagagctgaagaaaaatccaaaaacgatcgtttttacagaaggaacagatgagagaattcttgaggcagcttcccgtcttttagcaggaagcttccttacaccaattcttgttggaaataaagaagcagtattagaagcagctgaaaagtatggatacaacatccgtggcggagagatcattgatccggatgattatgagagatttgacgagatggtagaactgttctgcgaacttcgtaagagcaaaggtgttacaccggagcaggcagcaaagacacttaagaaaaacaactattttggaaccatgctggttaagatgggagttgcagacgcacttcttggaggagctacttactctacagcagataccgtacgtccggcacttcagctgatcaagaccaaaccgggatcaagctgtgtatcttcctgcttcattttggttcgtccgtcagctacaggtgagaacgaagttcttgctatgggtgactgcgcgattaatctcaaaccatcagaggatcagcttgcagaaatcgcatgggaagttgcagaatgtggtaaacactttggtatcgatccaaaggttgcattcttaagctactctacacttggatctggaaagggtgaagatgtagataagatgcgtaatgcagcagcaaaagcaaaagaactgtatccttcacttccgatcgaaggagagcttcagtttgatgcagctgtatctccgcgtgttgcaagaacaaaatgcccgaacagtgaagtagcaggtcaggcaaatacatttatcttcccggatatcaacgcaggtaacatcggatataagatcgcacagagacttggtaactttgatgcatacggaccgatccttcttggtcttaatgcaccgatcaacgacctgtcccgtggatgcaacgcagaagaagtttattctatggcaatcatcacagcagcactcgtagaagactaagagtattgacaaatattcagacgaaaattataatataacaaacaagggcgttttcaaaatggattgagaacgccctttttgtggatacgatgagccaagtgcagatttgtgcttgcacaacggatctgcgtttggcgaatgtacatcacctgatgttggaaaaggtaaaaaatcctcttgcaagcaagcttgcatcggctttctgaccttttgaccctggtatcatcattttatttatgagtagtaaaaacgggaggatttgtatgaatatgaaaaattatacgagagaagatatcctgaatcttgttgaggaagaagacgtgggatttatcaggctgcagttcaccgatattttcggaacaatgaagaatgtagcgattacagtaagccagcttaagagagcactggataataaatgtatgtttgatggatcttcgatagaaggatttgccagaatcgaagaatcggatatgtatctgcacccggatctgaatacatttgaaatttttccgtggcggccgcagcagggaaaggttgcaagatttatctgcgatatttacagaccggatggaacagcttacgaaagcgatccgagacatgttcttaagaaggtactttccgagacaaaagagatgggatatgactttaacgtaggaccggaatgcgaatttttcctgtttgagacggatgatgcgggaaatccgacgacgatttccaatgaacgtgcaggatattttgatctgggacctttggaccagggagagaatgcaagacgtgatattgttcttacaatggaagatatggggtacggtgtggaggcatctcatcacgagatggcaccggcacagcatgagatcgatctggaatatacagaggcgatggatgcagcagacaatatcatgacatttaagcttgttaccaaaacaatcgcaaaaagacacggtcttcatgctacatttatgccaaagccaaaggatggtatccatggctcaggaatgcatctgaatatgtctctgtcaagagatggaaagaatgtttttgcagatgaaaaagatccgaatggtctgagcaaggaggcttactattttatcggcggacttatgaaacatatcaaagcgatcagctttatcacaaatccgatcgtgaattcctataagagactggttccaggatatgaggcaccggtatatattgcttggtcagcgaataaccggactcctctgatccgtattccacgggtatcaggggaaagcacaagagtcgaactcagaagtccggatggggcagcaaatccatatctggcacttgccgtatgtctggctgccggaatggaaggaattaaaaacaagatcctgccgccggagagtgtagatgaaaatatttacgaaatgacagatgtggtgaaaaatgcacttggaattgaggagcttccggcaagcttaagagaagcaatcacagaattccagaaagatcagtttatgcaggaagtactgggagaagaactgtcacagaagctgatcgagtcaaagcgtgcagaatacagagaataccgcactcaggttacagaatgggaaattaatgagtacttacagaaattctaaagaaactttccaattctaaaggcaggaggctggtattatgagcagtattattgttgtatttccaaaaaaggagattgcaaccaatattcgcaatatactggtacgaaatggatttgacgtgattggtgtgggggtaaccggagcacaggcggttcaattggcagataatctggatgatggaattgtagtttgtggttataaaatgacagatatgttatataatgaattgagagattatctgccgagtacgattgagatgcttttgatcgcatcgccggagaaatgcagtgacaggacgccgggagtgatcagcttgtcgatgccatttaaggtatttgatctgatgaacacgatcgagatgatggcacaatcgattggcaggcggagaaagaaaagaagagcagagcttaagaaccggaatccggagcagcaggcacttgtaaaagaggcaaagagtcttctgatggaacgtaataatatgacggaggaagaagcgcatcgctatctgcagaaatgtagtatggagagcggtgtcaatatggtggagacagctcagatggtacttagtattatggcggaataaaggagattaaagaggcaggatatatgatctttacaaaaatgcatggtcttggaaatgattatgtgtgtataaactgcttcagagaaagggtggaagatccacctggatttgcaagaacactttgtgacaggcattacgggatcggagcggatggtctgattctgatatgtccgtcaaaggtgtctgattttaaaatggagatatacaattcggatggatctgttgccgggatgtgcggcaatggcatccgatgcctgggaaaatatgtatatgattacagacttaccggaaaggaaactctcagtatcgagacgaaatccggaattcgtaacatgtaccttcatattcaggatgggaaagcctgcggtgctatggtagatatgggtgttccaagactgaacgcacacagcattccaatcctgagcgaaaaggatctggtgatcaatgagccgattgaggtacaggagaagaactaccgcatgaccgggatttcgatgggaaatccgcatgcggtaatcttttcagaagagataaacgggatttctctggaagagacaggaagggagttagaatttcatccgagatttccggagagggcaaatatcgagttctgtcatgtgactgcgagggaccggatggagatccgtgtgtgggagaggggggttggtgaaacgcttgcctgcggaaccggagcatgtgcagcagttgtggcttctgtgctgaatgacttgacagatgaggaagtaatcgttaaattattaggtggagagttatctgtcagatgggaccgtaaggtgaatcatgtatttttggagggacctgcggttaaagtatttgatggtgtactataaagatcaaatcacaaaggagacgacatatgtacagtgtaaatgaaaactacttaaagttaccgggaagctatctgttttccaatattgccaaaaaagttgcagcgttctcagcagcgaatccagatgcaccgatcatccgtttgggaatcggtgatgtaacacagccgcttgcacctgcgatcatcgaagcgcttcacagtgcagttgatgagatggcacacgcagagacattccacggatatgcaccggatcttggatatgaattcttaagaagcgcgatcgcaaagaatgatttccaggcaagaggatgtgatattgctgcagatgagatctttatctcagacggagcaaagagtgattctggaaatatccaggagatctttggacctgactgcagaatcgcagtaggagacccggtatatcctgtatatgtggatacaaacgtaatggcaggacgtaccggaacttacgatccaaagacagaaacatggagcaatgtaatctacatgccttgtacagcagaaaatggatttgtaccggaactgccaaaagaagtaccggatatgatctatttatgcttcccaaacaatccgaccggagcggctatcacaaaagatgaactccagaaatgggtagattatgcaaataaaaacggggcagtgatcatttatgatgctgcatatgaagcatatatcacagaggaagatgtaccacacagtatttttgaatgtgaaggagcaagaacctgtgcaatcgaacttagaagtttttctaagaatgccggatttacaggagtacgtcttggcgcaacaatcattccgaaagaccttaagtgtggagatgtgatgcttcattcgctgtgggcaagacgtcacggaacaaaatacaatggagcaccttatattgtacagaaagccggagctgctgtttatacagaggccggaaaagcacagataaaagagcagatcgcatactatcagaagaatgcaagaacgatttatgaaggtctgaagaatgccggatacacggtatccggagcagtgaactcaccatatgtatggttaaagacgccggataacatgacttcatgggaattctttgatttccttcttgaaaaagcaaatgtagttggaactccgggatcaggatttggaccgagcggggaaggatacttccgcctgacagcatttggaagttacgagaatacgttggaagcgatcaagagaattgagaatatttaattgaaaatctggctgcagggacgggcgtcggatcacggtgtagatttgacggtggactctggcgtgaacagcctgtaacatgaaaagaaagagaaaagtgtgataccagactcattcgacggaaaatctgatgattttccatctcaggagtcttcggagtttcgtacttggggtacgaaatccgatcacacttttctctttttttcattaacaggctgtaacacgccgccatataccgccaaatccacaccgtgatccgacgcacttggcgctgcagacaatttaaaatgatacctggctttaagctttattcaaccgttatgtgtgtctataccaaaacaaaatcactcataacatataagccagaataaaagtaaacacaataagaattaatttcaattctgaacaaacaatccttccatccacagcgaggcgcatctatgatgtgccaatgcggaagctttgaataacgtaagggctgagcggggacgaggtgacggtttcacgccattcgtaagagccgtgcagtctgttaatttaatcgggacggaaattgtgaccagatttcgtactacaagtacggaatctgaggactgcctgagccggaaaatcatcagattttccagcgaatcagtccggtgtcgcaactttcgtcccgattaaattttacagaatgcaggcgatgaagaccggcgtgaaaccgtcacctcgtccccacttcgcccgtaaccttattccaaacttcctctaaccggtatgagactccgctccaatacccctttcaggtgagcaatagcggttccgtagttcgtgatcggtacgccctgatcttcggcgcatttgaggcgatactgcatttcgcgttcgttcagggtgcagccaccacagtgaataatgagtttataaggtgaaagatctaccgggaattcggtcccgcttgtgaattcaaagtgcaggtctttatttccggtatgctggcggatccagcgaggaagcttcactgttccaatgtcatcacattgcctgtggtgggtgcaaccttcacagacgaggattttgtcaccatcttccaacttgtccagcatctgtgcgccttcgacctgaagtttcagatttcctttgtatctggaaagcaggatggaaaaagaggtcagtggaatatcttccggtgtatcggcagacactttggcaaatgcctggctgtcggtgatgacaaggcgtggctttttgccaagagacgaaagtgtttccttcaattctgtgtcacgggttacaatagagattgcaccagcctccagtacatcgcggatggtctgctgctgcgggaggatcagacgtccttttggggcggcagagtcgatcgggacgaccagaacgacaaaatcatttggatttaaaagatcgcggacgagatatttatcctgatcttctttcggagcctggcttgcaatcagttcttttaattcatgaacatggtatccggttactgtgctgacttcgatactgttggaagcatctatatgaaaagaagcatccggcatagaatccaggttcggacagactgcgccattttcagcagaagagcagaggtcagatttattttttaccacaacgtaaggaatcttcttatcttgtattttctttaagatggataaatcttctggtgtcatgccaagagaggcatcgattaccagaacagcgatatctgttttgtttaaaatctggtaggcttttttgacacgcagttcaccgagttctccgatgtcgtcaagccccggggtgtcaatgatcacgacaggcccgaggggaagaagttccattgcctttggaaccggatcggtagttgttccgagaacatcagatacaatggcaagattctgtccggtgatagcgttgatgatgctggattttccggcatttctgcgaccgaagataccgatatgtacacgatctgcagaaggggtgctgttaagactcatagtttttgtaatctccttttttgtattctttttgcgcaggaattcctttgcagtcagtttgaatctggaaatagtgtaacacatatactatagaaaatcaattttgtgaaaatttacttaaaagaaacatataaaactggcaattttggataaaagtttcattgactaaagtgtgaaagtacggtaaaataatcacaagttcataaagaacagaacagacaaggatgtcgcatcagatgcggcatcctttttgtatttcagaaaagaaagtaatcagaagtgcaaagtaatttctcaaacaatcccgggaacgagagagtgtctgcggacggaaatgcaagggcgcattacaaaagaatttgtgatgcgcccttacgttttcactacacagttaaggaggattattattatgaaaaaaagattaatagcagttttaatgtgtgcagcaatggtaacagtacttggagcaggatgtggaagtaaaaaagaagatacaaaggaaacctctgatacaaagaaagaatatacagaagacgagctgaaggacagcatgaaaggtgtcaaactgaaagtcggaacaaccggacttttcggaccatttacatactatgatgaggacggaaagacgctgatcggatatgatgttgatctgttaaatgatctgcaggagcttctgggattcgaaatcgatggtggcttccaggcaatggattattcggcacttactacttcacttgctgaaaataaactggacatcggagcagcagcactttgtgcaacagatgaaagaaaagaagttatggacttcagtgatatctattgtgattccggtcaggtcgttatggtaaataaaaatgacgataaaggaattaagagtgttgatgatctgaaggataaaaaaatagccgttgaaaagggaaccgcatctcatacttatgcaagcaagaaccttacaagtgcaactctcgaagtacatgacacgatcacaactgcatatgaatctttggagcagggaaaagtagatgctgttattcaggatggacctggagcatatttctatattaagacaacaccggacagcaacctggaggtagtcggggatgagtttaatcagggccaggcaccgtattgcgtagcaatttctaaagaatgcaaatattatgatgaaatcaatgcagctgtaaaggtactgattgataatggcacaacagatgaactctatgcgaaatggtgtgaataatcaaagaacagacagcaactaaaaagaagataggatgagatagtatatggatatgacttttttgaatgttttacttccaatgatgtttgagggattaaaacttacgattttaattgctgttgtcggtatcacaattggcttcctgatcggaagcctctgtggatacctgcttcagtcgaaatataaaatagggaaagcaattgcagaagtttacatttggatcattcgtgcgacaccacttatggtgcaggctttatacggatattttgtaattccgaagcttttgggtgtcgatattggaagcactgcagtgggaattggcgttatcgcactgaattccggtgcatttatttcagaaattgtaaaaggtgcgttgatgagcattgatccgggacagaaagaagcaggtgcatcacttggacttacaagtgcacagacgatgatccatctggttatcccaccggcatttaaagcggcacttccggcattatttaaccagtttatcatttctgttaaggataccgcacttttatctgcgattgcggttaatgagatcacgcatcaggcacaggcgtatgcagcgttgagctttaaagcaattcctacatacacagcactggcagcgttttatctggtgatactttcggtactgataattgtccagaaacagatagaaaggaaaatgaggtgattggtatgattaaagtaaatcatttgtcgaagaaatttgggaacctggaggtattaaaggatatcaatcttgatatcaatgaaggtgaagtggtctgtatcatcggaccttccggatcgggaaagagtactttcttaagatgcatcaatcaacttgaaagaccgacaggcggaaccgtacagtatgagggaaagaatcttctcgataagaattgtgacatccgcaaattccgtgaggaagtcggaatggttttccagaaattcaatctgtttccgcttaagaccgttgttcagaatgttatgatggcaccaatccttaccaaacacatgaataaggaagaagcgcatgcaaaagcactggaacttctggataaggtaggattaaaggataaagcggatgtatatccgagtacactttcaggtggacagcagcagagagttgccattgcaagagcactggcaatggaaccgaaagcgctgttgtttgatgagccgacatcggcgctggacccggaactggtaggagatgtacttgatgttatgaaatctcttgcgaaagaaggaatgacgatgatcgttgtaacacatgaaatgggctttgcacgtgatgtggcagatcgggtcatttttatggcagacggatatgttgttgaagaaggcagaccggatgcaatttttacagcaccaagagagagaaggacgcagtcattcttatcccgtgttcttccggcaactgcataaataagacgttttgtaaaaattattgatatactactcataaaggggcaggtgagagcctgccccagtgtaaaaaagatcaagaaaatgagtaaaatacttccattgactttcccatatccgattgttaaaataagaagaaagctaaagaagggaccttcgccatacggcggaggtgtttttggcttatagaaaaatataatttctatattatgatgtaagtgtcaaaagtatcaattgcgtttgtgctcgcacaaataagcaattgatacttattgacactcacatcatattattaaaaagctggagatggtgtgtatggaggcaccactgtaaaaggagtgtagaaaagatggaaaagaagaggagtaattttaccggctcgatcggattcgtgctggcggctgcgggaagtgcagtcgggctggggaacatctggagattcccgtatctggcagcaaaaggtggaggcggagtgtttattctgtgctatgtggtactggcacttacctttgggtttacgttgctgacaacagagatcgcgatcggacgtaagacaggacagagtccgcttactgcatatgaacagatgcataaaggatggggaggaatcggtgtgcttgcatgtgcagtaccggttatcattcttccatattattgctcgattggtggatgggtactcaaatatttgtcggcatttctcacaggtcatggggcgcaggcagcagaagacggatattttacaggctatattacacaggtcggacagccgatcatatggatgctgatctatgtgcttattacggcaacggttgtttataaaggagtaaataaaggaattgaaaaatacagtaagattctgatgccgatcctgtttgtactgattgcgggaatttctgtattttcccttaccctgaaacatacaaatgcagatggagtgacaagaaccggtatgcagggactggcgatttacctgatcccgaattttagagggatgacggttaaaagtttcctttcggttgtgatggatgcattgggacagcttttcttctcgatcagcgtggcgatgggaattatggttacttacggatcctatgcgaagaaagagaccaatctgatgaagtcgatcaaccagattgagttttttgatacgcttgtagcgcttctggcaggacttatgatcattccggctgtttatacttttatgggaaccgaaggaatgtctgcaggaccgggactgatgtttgtatctctgccaaaagtatttaaagcaatgggggcagcaggagtgttggtaggaattgtattctttctgatggtatcttttgcagcggttacttcttctgtatctgttatggaggcaatcgtatcaagcatgatggataaattccatgtatccagaaaaaaaggaacgatcttgactactttatatggaatgatcgttggtgtgatcgtatgtcttggatacaacaagctttatttcgaactgaaacttccgaacggcacggtagcgcagattctggacgtgatggattatatcagcaataactgtctgatgccgatggtggcactgcttacctgtattctgatcggatgggttgtaaaaccaaaagtgatcatcgatgaagtgacacttggcggatacaggtttggcagagaaaagctttatgttgcaatgatcaaggtaattgcaccgttgatgcttctgattcttttagtgcagtccgtaggattataaaaagaaaatttcagaaaaggcttgacatttagtggaaaataaattattgtaagttacagattttggtgtgtaactgtacggcaggcattaaccatacatagatattattttgatatttgtgtggggttagtgccttttttgcgtcaaaaattcggataaaaggcttccacgaaaggaaataatatcataggcataagccaggtaattaaaatttcttgaggaaaaggagtacatgcaatgaaagacaaaatttttggcgtattgcagcgagtaggaagatccttcatgcttccaatcgcaattcttccggtagcgggtctgctgctgggattcggtagctcgtttaccaatgctaccacaatccagacttatggtctggagaaaattttaggagacggaaccatcctgaattcgttactcattatcatgaacaaagtaggaagtgctgtatttgacaacctgccactgattttcgcggttggggttgcaatcggtatggcaaagaaagaaaaagaagtagcggcactttctgcattgatcgcattctttgttatgaatgttgcaatcaatgcaatgcttgtgatcacaggagagattaccgcagatggaacgatcgcttcgaatgtactggaaggaaccatcacttctgtttgcggaatccagtccttacagatgggtgtgtttggtggtattattgtaggacttggtgttgctgctctgcataaccgttttcacaaaatcgttcttccaaatgcgttatcattcttcggagggtccagatttgttccgatcatttctacactggtgtacatgtttgttgggattggaatgtattttgcctggccggttgtacagaatggaatttatgcacttggcggactggtaaccggaagcggatatctgggaaccctgatttttggtattattaagagagctttgattccgttcggacttcatcacgtattttacatgccattctggcagacagcagtcggtggaacaatggaagttgcgggacagatggtacagggaggacagaacatcttctttgcacagcttgctgattctgcaaatatcgcacatttcagcgcagatgcgaccagatatttctcaggtgaatttatctttatgatcttcggacttccgggagcggcacttgcgatgtaccgctgtgcaaaaccggaaaagaaaaaacaggcaggaggacttctactttctgcaacacttgcctgcatgatgacgggtattacagagccactggaattctcatttctttttgttgcaccggcactttttgctgtacaggtagtgcttgcaggttctgcttacatgattgcgcatatcctgaatatagcagtaggacttactttctctggtggttttctggatctgttccttttcggtatcctgcagggaaatgcaaagacaagctggcttcggatcattccggttggaattatttatttcttcctgtattactttatcttcagtttcctgatcaaaaagtttaacttcaagacaccgggacgtgaagatgatgatacagagacaaaattatatacaaaggcagatgtaaatgccagaaaagaagcaggaaaagaaacagcagggaatacagggaccgcagatccggtaagtgaggcaatcacacaggggcttggcggaaagaaaaatatcagtgatgtggattgttgtgcaacaagacttcgtatcacagttcatgacgcagcccgcgtaaatgatgagatcatcaagacaacaggttccagaggaatcgtgaaaaagggacagggtgtccagatcatttatggtccacaggtaactgtgattaagtctaaactggaagattatctggaaacagctccggatgaatattatgagagcgctgctgtgtcagaagagaattcagctgaagaaaatacagatactgtaaatgaaaataatgaaacccaggaaaaagtggtaaatacaattgttgtatccagtccgatcaccggtatggcaggcgatattacaacctgtccggatgaaggatttgcaggaaaaatgatgggtgacggagctgttgttacaccggaagatgctgtgatctgcgcaccggaagatggagaagtgcttttcgtatttgaaacaaagcatgcacttgggttccagacagaaagcggacttggcatgctgcttcacatcggtattgataccgtatctctgaacggtgaaggatttgaagtatttgtagaaaatggtcagaaagtgaagaagggggatccgcttatgaagatcgatattccattcctgacttcgcatgcaccgtctctttgttcaccggtactttgtacagaactggaagagaatcagagagtacgtctccttgcgacgggagaagttaaagccggcgatccactatttgccgtagatacagtagaatagaacagcgaaagctgttttaataatggcggcgctttggcaagcaaaacgctgtcaaaaaagtaaactaaaaatgaaagaaaaagacgaggagaatttatcatgaaagaatttaagtatgtagtaacagatgcacagggaatccacgcaagaccggcaggaattctggtaaaagcctttcccgtaatcatacagaactgatgctgaatggcttcggtgccaacgtacagacagaaatacattctgatggcagtgcaactgcatctattctcccatgtgaggaattatacggacagaagatcctggttcccggagatatttcttctgctgcttacttcatcgctgctgcccttctggttccaggttctgaacttctgataaagaatgtaggtactaacccgacccgtgccggaatccttgaagtatgcagggcaatgggggcagacattacctatctaaatgaaaattgtgacagtggtgaaccaactgccgatcttcttgtacgtacaagcactcttcacggaaccaccgtagaaggtgcaatcatccctacactgatcgatgagattccgatgattgcagtgatggctgctttcgccgagggaactacgatcatcagggatgctgccgaattgaaggtcaaagagactgaccgtatcaaaacaactacagaaggacttcttgccatgggcgttgatgtaacaccaaccgacgacggcatgatcatccgtggcggtaatccggttcatggaggacagatcaacagttatctggatcaccggatcgcaatggccttttccatcgcagcccttgccgccgagggaaatactgaaatccaggatggtcagtgtgtagatgtatcttatccttcattttttacggaacttcattccctttccctgtaatttcaggaaaaaatacaaaaaaagaaagccgcacactacataagcagtgtacagctttcttttttatgcgccctgtcactgtttctctaatccgtgaatccagtctgtcttaagaaacagaatcaaaaatatcaccgaactgataaaccaggtaagtggatatgcccagtagattacattgatcaccggaataatcctaataacaatactaatataggttacccggactccgcaccatacaatcatcataacaaacatcggaacaatacttcttcccgcccctctctgaattgctgccatacaatgcgaaaacgcaagcagacaatagaaaaaagcgatcgtatgtgcctctgcaattccatattcaattgctttttgatctcctccaaacgcagcgatcaggtatggtgaaaagaaaaaaactgctattccgatcacttctgctatcccgattccacaaatggttccaaacaatgcccctttttttgtccggtcatactcttttgctcccagattctgtccaataaacgtcgtgagtgcctgcgagaagcaggtaaccggaataaatccaaatccttcaattttggaatatgacccacacccggccattgccagagccccaaactgattaatattcgactgtacaaatacatttgcaaccgcaataatggaattctggattcctgccggtattccgtttaccacgatcagccgcagcatattcccatccatccgcagttcacgaaaagataaccggaacgcctctggttccctgcgcagttttctgatacacagaaccgcacttaatatctgtgaaacaatcgttgcaaaagctgctgcacctacaccaaatcctaaacctccgatcagcaccagatccagaatcacattcagacacgctgaaatgatcagatagatgaccggactcttactgtcaccaagtgactgcaaaatccccattccaaagttataaattacaaatccaagtgaacctgcaaaatacaccctgaaataaaccagtgatttcggcagtacctcttccggcgtaccaatcagttttaaaatctgcggtgcaaggatcaacgcggcaaccgtaagaaaaattccacatacgccaccaaatgccagtgccgtatggattgcttttttcagcttctcatattctccggctccaaaatacctcgcaatgacaacaccggctcccacgccaattcccccaaaaaatcctaccatcaggaatatcagattccctgatgagctgacagctgcaagtgcattattcccaagaaaatttcccacaatcagcgaatccgccacattatacaactgctggaataaatttccccatagaagcggaatcgcaaacataataatctttttcggaatagatcccgttgtcagtagattagcgtttgatgtttcccccataattaaccttgtcctcctataatattttaagtctattatactcctgatacggttaattcaccagcaaatatatcggaagcaatatttgattcttttttaataaatcataaatctattttttcatcaattattataacctttttaaattatccttcaatgtatattgcattttccatcctcttccattaaactattatgatatatactataaattttttgggggaactttctatgcaaaattatcttgaatttatcggaaacgaactgaaagctttaacttctattccaagcccatccggttataccaaagatgtggctgcatacctgatgaagactttatcagatatgggatatgaaccacagctttctaacaaaggcaacgtattcgtaacgatcggcggagaggggaatccgctggtacttgcagcacacgttgataccctcggtgccatggtgcgttctgtcaaagcaaatggaagactgcgtccgactactctcggtggacaccagtggagtaccgctgatggggaaaactgcacgatccacacacgcgacggacgcgtttataccggtgtagtactaaatactgaaccttctgttcatgttgcagattctgctgttgagacaaaagaagaaaatatggaaatccttctggatgaaaatgtggacactaaagaaggaactctttcacttggcgtacagcctggagatatcatcgccatggacccgcgtacccagatcacaccgagcggttatatcaaaagccgtttcttagatgacaagctttctgctgccatccttctcggtctggcaaaatgcgtaaaagatgaatctattgcgctttcccgcaaagtttctcttcttttcactgtatatgaagaagtcggacacggcggaagttttgttgccgaagatacaacagagatgatttctgttgacatgggctgcgtcggatccgatctcggatgtaccgaacgcatggtatctatttgcgcaaaagattccggcggtccttacaactacgacgtaacatccgctcttgccgaaactgcaaaagaagaaggattggattatgcgatcgatgtgtatccgcattacggttctgatgtagaggcaactcttcgggcaggatatgatatccgtcatggtctgattggtcctggggtgtatgcatcacataactatgaaagatcccatatggatggggtaaagaatacgcttttgttgttgaagaagtatattcaaaaataaaaagtataaatagctaacagccaaaaataaaacatctgcgatatgcataccgcagatgttttattttttcaatattagtcatatttttcttaagtctggtaaatgcaagtgcctcttctaccagttcttttctctttttcttatcttgtcatgatctggatgatcgttttatccgtctcacgcattcccttctttgcaagctctccaatattacggatcgtgttttctacacctttttctacaagtccgtctccgccatagaactgctttccatttttctgcatctgaagtcccagaagtcctgcttctacagctgatgcgatttttgccgcgcagcttgccttcgctccatcacacacaacacctgagttaatggcaactgcatttacaattacatgagaaatctcatatgcacgtccgccatacagataacagattcctgcacctgcaccacatcctgcactgatcgcgccacaatatgcagacagtcttccgattcctgtcttcatatggattgtgatcagatttgacacaaccagcgcacggagcatcatctcttttgagacattcagctcttttgcatagacgatcaccggaagagaagttgtcattccctggttaccgcttcccgaattaatgacaaccggaagttcacatccgttcattcttgcatccgatccggccgctgccatcgctttcgcacggttatgtacactgtttccatatgcttccatcaaagtctttccaatggcagctccccagtttcctgtcatgccctcttcggcaattgcccagttataatcaatctgtctctgcagaacttcctctacgtctgcaacgtctacgcagtctgcgaattcaatgatcttctccacagtcagaagagaacggtccgtcgcacagctggatccctgctcttcatatgctttttctctgatgatctcatcatctttctttacacagatcacattggtgtgaaaacctgcgatctctacgtatccgctgtgtccgcctgcacatgccttgatctggatgtcgaaaatatattctttatcggattcccggattgtcatcggcatggtatccagcatctttttcatttctactttctgttcccctgtgatctcttccagaatttccagttctttttccggacatccggctacaatccctgcacagactgctgcaccgattccgcgaagtcctcctgtgcacggtacaacgacactttttacattcttaataatatttgcactgacatttacttctacagattccggtttttccccaagagcctgaactgcaactgctgccgcgtaagctactgcaatcggctctgtacatcccatcgccggaagcaactcttcctttaaaatttccacatattcattgtatattttttgttccatcttttctctcctctgtcagatgacaccccattcatctttttattgttccctgtttattttatagtattcctgcctttcccacaagcttttctctccattttttcagggtttacataattaccatgattacattccaaaaatattcttttatttttatttaacgcctccgaaaattttcctgtaacatttttagtcaaatttctctgttatatcatcacaaaatgccgggcaacattttgtactgtccggcatttttctatcctgtagcaatttattttccaatctcttctctagtctctttaaaacatttgataatgaaatcaatatcttcttttgtatggctcgcgcatacctgtgtgcggattcttgcttttcctttcggtacaaccggataagagaatgcaaccacatatacccctttttccatcattttctttgcatattctccggcaagtctttcatcataaagcataaccggtacacatggatgggttccttcgatgatatcaaatccattttctaccagctgcttgcggtagtatgcggttacttcttccagatggtcacgaagctcggtgctttcttccagcatattgaacatctcaatacttgctcctgcgatcgccggtgcaagagagttggagaacaggtacggacgacttctctgacgaagcagatcgatgatctcttttcttccggatgtatatccaccggaagccccaccgagtgctttcccgagtgttcctgtaatgatatccactcttccttctacgccacagtattcggaagttcctctgccgtgtgctcctacaaatccaactgcatggctgtcatccaccataaccagtgcgttgtatttatcagcaagatcacagacaccttttaagttacagatgattccatccattgaaaatacaccgtctgtagcgatcagtttgactcttgctcctgctgcatctgcagcctgaagctgtgcttccagatcttccatgttgttatttttgtagcggtatctttttgccttacagagacgaactccgtcaatgatggaagcatggttcagttcatcactgatcactgcatcctccgcagtcaggattgtttcaaacagtccaccatttgcatcaaagcaagaagaatataaaatcgtatcatctgttcccagaaatccggaaatcttcttttccagttttttgtgaatgtcctgtgttccgcagataaatctgacagaagcaaccccatatcctttttcatcataagttctcttcgctgcatcgatcagtctctgattgtccccaagtccaagatagttattggcacacatattaagaagctctcttccgtcttccattacaacctttgcgccctgcggagatacgaacggtgcttcccctttgaaaagaccatctgctttgatctgttctacttcttttgtataaatacttaaaatatcattttttcttgccattttattctctccttcttctgcttttcctaatcgttaatatgtgcccagtcaaggatcacctttcctgactgtcctgagatcattgcctcaaatcctttttcataatcgcggatatcaaaatggtgtgtgatgatcggtgaaatatcaagtcccgcctggatcatcgtagacatcttgtaccaggtatcccatacttttcttccataaattccgcggatattcagcccattgaagatcactgtctcaagatctacggttgcatcctgtctctgcaatccgagaagtgcgatctttccaccatgtttcatgttatggatcatatcagaaagtcccggctggcttccggacatttcaagtccgatatcaaagccttctgtcattccgatctcatgcatcacatccgtcagtttttcctgtgtcagattaacacatctggtcgcacccatttttgctgccagatccagacggtactggttcatatccgtgattaccacatgtcttgctcctgcaaattttgcgatcgccgccgccatgatcccaatcggccctgcacctgtgatcagcacatcttcaccaagcatgtcgtaagataatgcagtatgggttgcatttccaaatggatcaaagatcgcatataattcttcatcaattgccggattgcacggccatacatttgaagcgggaataaccagatattctgcaaacgcaccgttccggtttactccaacgcctttggcatctttgcagttctctttgtgcccttccagacagtttctgcattttccacaagtgatatgtccttcaccggataccagatcgcccaccttgaatccctgtacacctgcaccgacttctacaacttccccgacatattcatgtcctgcggtcagtccgatcggaatagtatgttgtgcccattcattccactggtaaatatgtacatcggtaccacagattgcatttttatggatcttgatctttacgtcatttggtcctacttccggaatctgtactcttttcagccagagtccctgttccggtttttcctttactaacgcccacattttattatcattcatcttcattacctccgcatgacacatatgtccgtttaacgcggactttttattatttttgtctttctatacttaggataccctatttttcttctcttttcaatctacttttccgtgatgcacaaacattttacatattcatgtttttgtagcggatacaagcacatgtgtctttctattgcaagcacatttattatatatatacaaaaacagacagataaatctgtctgtttttcacaatgccctactgtcgattttcacaatttcgttctgtttataacaatcttttttctttctgatgtaccctttttctcacaaaatagaagcacataacctgaagtacaatagtaaggatccatgacaccggataggatacaaaaagtacggataaagatctgtggttcggaaaaattccaaatacccacacaattcttgttcccaccgttccgatcactgaaagcaccatcgggactgctgaatatcccattccacgaagcgcacccggaaacaaatccatgatcccacacagaaaataagtgatcgatgtatacgccaggatttccattccgcagttgataacctttggatctgaagtataaactgtcagaatctgcggtccgaagctataggcaagaccaccaagcactgccgcgatcgatatagacagaatcgcacagtcacgcagcaccttatccattcgtttcagcttacccacaccataattctgactggtaaaactcatacatgcctgggtgatcgaattcactgacatataaaggaacccaagtatattgttcgctgctgtatagcctgccatcgcaatcgatccaaatgaattaaccgaagactgcaacagtgcatttgacaaattgatgaccgtactctggattcccgccggaactcccacctggaaaatctgttccatgtaggcaccattgatcttcagtttggagaaacgaagctgataacttccttccgaccggtacagacaggtcagtaccagcacacaggaaatcagctgtgaaataattgttccaattgcaaccccggcaactcccatatgaaaaagaataaccagtatcatgttcagcgcggcatttgcaattccggaaatgatcaggaagatcaatggcctttttgtatcaccgatcgcccttaaaatggccgccccatagttatataacataaaaaatggcattcccataaaatagatccgcatatataaggcagactgcccgatcacatcatccggcgttcccataatttcaagtgcccactttgcaagaagcaccccgataactgccatcataattccactgatcagcgcaagtgtgatcgaagtatgtactgtttccgacatctcccggtctttgcccgctgcataaaatctggctgcaagaacattggcaccaagtgaaattccgataaacaggttcgtaaacacattaatcagtgctgttgtggagccgactgcggcaagtgcctgactcccggagaatcttcctaccacgatgatatccactgcattaaacgcaagctgcagaattccggaaaccataagcggcagtgaaaaagagatcagcttgtccatgatggagccgttgcacatatcaatttcaaacttattttttttcacattattcacccagcccttcatcaaatgtaagtctcatctgattccagaccacgtttccatgtactgattctgagacaccttcatttttgaatccaaacctggcataataagatatcagccggtccttgcaggtaaggacaagtccctttcttccctgctcttttgcatctgtaatcgctcttttgatcaattctcctgcatatccatgtttccggtaagacggcagcgtatttacaccaaaaatcatctgccagtcacctttttcatcatgcatttccgctttttcatacatttcgtctgtcagatcttcctgattcgtcaccataccgtccacgaaggcgatcaacttctcttcttcaaacatcagccagaaatgatctttataaaaagtaagtctcttttcaaattcttcttctgttgccgcttctgctgccgggaaacacgctgcctccacacgggcaatttctttcagatcactcagatctgctgttcttattctcatctttactctccctcttttcctagtattttcagcattttttctacattttcgctggtccatgccggaaattctagtaccgcatccgggatatcctgccttccggaatccgggttgtggaaccagatacatttcataccggctgctctggcagctcctccaccgttagtcgaatcctctactaccagacagtcctccggctccattcccagtttctctgccgttacaaggaaagtatccggtgccggttttggatgctctacataatctccactcatgaccactgtaaaatatttctccatatccagagactttaatgcatctttgatcgcataagccggagaggaagacgctactgcaagcagatatccttcgtcttttaactgcttcaatgcttctttgattcccggcatctccggaaatccttctgcctctgtaatctgcgcttttttctctttcatgagcgcattcatcttatccacatcatcaaaaaccggcccataattctcattgatcaaatccatgaagaatccacgggtagaaccgatacacggaaggtagacctcatagtcaagatcgattccgttcttctcttttaaaatttccttccagcaacgatagtgtaatggttctgtgttgatcagaacaccgtccatatcaaaaataactgctttcatatctttttagcctcgattaaatgatttaaattttctttccgttcttattttgaatgacgtttttaaagatgtcaagacagagaagctaaaaagaatgtgcatctccggcacgtagtgccttttatttcataggaagtttcttcggaatttcctatgaaataaaaagagagcgactgtacgattcaaaaaacgcacaggcactctctttggcttttatggatttttcttaaggtctctgtcccattccaccttctaaggtgatcgtctctccgttcatatatttgaaatccggtgatgcaagctgtacgcatgcacgtccgatttctttttctacatctccgtaatgtccagccggcggcatctttacatttgccttgaatgcttccggataagctttctggaaattctcaagctgtgctgtccatgcgagcgggcatacgatattgacattgattccatctggtccccactctgttgcagctactctggaaagtccacggattccttcttttgccgctgcatatgcgcactgtccgtaatttccgaaaagtccggcacctgaagcaaagttgataacagatccctttgtctctttcaggtacggatagcatgcctgcatataatagaataccgcatatacgccggaatacattgccagattgaactggtctgttgtatgatctgcgatcgtaacaccagatgcggatgcctgtgcattattgatcaggacatcaattcttccgaatgtgtcaattgcctgctttactacgttctgtactgttgcttcattatcagcccccgcgctgacatcagcctgtacaggtaatactttgataccatagagtctctccagttcttctttggcatcttcgagtttctttacattacgcccggtaattaccagattcgctccttcttttgcgtaagctgttgcaattccatatccaatagatccgcagcttccatcacttaatacagctcttccgccgcctgtgataattgcagtctttcctgttaaaaatcccataatcaatttctccttcctgctgtccttcaactagcatacaattataataacagagtacaggtcagaattcaacactgaattgtgtctattttctgacaatatagttaattttttgattatcgcaaagacagttagaatgtaaaaacctcattaaataaggggtgtttattatatagataccagggtcaaaaggtcagaaagccgatgcaaaacgcacgtagcaatctggtatcaaaggggtcaaaataccttttgcccccaacatcttatctatctacaacatatacaatagtgcattgcagatacatgcagcaatattgctgccaccttttctgcctcttgccacgatatatggtgtgtctttcagtgaaaggattaactctttagactggacaacatttacaaatcctacaggaactccgatgatgagttctggggttaatttgccatcctggatcagttcatagagtcttacaagggctgtcggggcatttccgatggcaaagatgatttttttatcgagggtggctgctttttccatgcttgcaacggcacgcgtggttccgttctttttggcagtttctgctacatcttcatcggacatgaagcaaagaacttcgcttccgtattctgcaagcttccgtttgttgatacctgcttttcccatctgggtatcggttacaatgactgcaccatttcggatggcatccagcgctttttctactgcaccttctgaaaacatcaggttcttggcataatcaaaatctgcgcttgtatggatacagcgtttgacgatcggttctgttccggggatcagatgcgtatcacccagttcttctgttatgatctcaaaactgcgtttttctatttctgcaggttttacattttccagttctatcttcacttgatatttcctcctttgatcgtcacaccgatcccgcatactacccggtctacctgatctgaatttgccgcaagtacggtacagatccttccggtcagttccctgtatctgcgatcaaatgcgtctaccggaaccagaccatagccgatttcctgtgtcacaattacaatatccggacacttttttgttagtttcgatgcgaaatcaattgcttctttttccgaccagttttctttttttatcatgctctggatatatttttcaaaatgaaagactccctctgcctcaaaaatattatctccttcacatagttccccatccgtccaatgaatgtatgggttctgcttttttgcatacgcaagcttcccctgatatgcaccgccgattatcattttcatttttttatatctttcctttcaaccggaattccgtacacaacttctgtcaccagatctgccatctctcccatccgaagatttagctttccgagaagcttcagatattcttccatctccggattatctgtcatgctgtctgaaaatacttcatttgtaacaactaccagatcatcactgaccttctgcagcttatgtatccccgccagaatggactcttctgcattttcacctgctcctgacggatcgtacatttcatttgccacaagattggacatacattccaggagaacacttcctgtctcttttgtctgcagaatttctgcagcttttttaagatacgtatagcattcgatcgtttcaaaccctttacctgcacgaagccttctgtgacgtgcaattttctcttccgtttccttcccgaaaggcatcatagttgctatatagtagcgttttttgtttctttttgaatagctggcatattccataagcttctgctctgcatattcggatttaccgcttccactgccacctgtgatcagatgaaacattctgctgcatttcccttctcgataatctcatatattttcttcatatccatattctcacgaactgcatttgcaagaatctgatactgcttctctttgtaagcatggtagtccatggagtgcatggcttcctcgccgtatcctttttcttccagaagtgccccgatcagtgcatccgctacttcccggtcatcaaaaatcccatgtacatagcagccatacacattcttcttctgcgctccatcccaccggctctcacctgtcacctgatcacagatctgtaccatcatcttatgatctgcagcatctttatcagaaaaaatagtttcccccatatggatctcatatccatccagctttgcaccggacattgcttttaaaattccggtaacttctccgaaccttccggtaacacgggttcttctcttggtattttcaaatacagtaactgcaggaagcagtcccattgcatttatggttccaccacattctaccccttccggatcacggatttcttctccaagcatctggtaaccgccacagataccaaataccggtttccctgatgaggcatggcgcagcactttcccttccagtccgctctgacgaagccacaacaggtcttccatcgtatttttacttcccggcagaattaccagatctggattcccgaaatctcctgcctttgacacataccgaagcgaaacttcttccctgcattccagtaccgcaaaatctgtaaaattggaaatacgcggcagacggatcactgcaatatccagaagtgccgccttttctttccgctcaaacctttctgacagactatcctcatcatcaatatccgcataaatatatggcatcacgccacataccggtatctttgtccactcctccagcatcctgatacctggctccagaattttcacatccccacggaacttattgatcaccgtacctttgatccttgcccgctctttttcttccaacagcataaccgtcccgacgatctgcgcaaacacaccaccacggtcaatgtctccggcaagaagaaccggtgcatccaccagctcagcaagtcccatgttgacaatatcattctgcttaaggtttatttctgccggacttcccgcgccttcaatgacgatcacatcatacttttcttccagtttatgataagcttctaaaatagccggaatatattctttctttttacggaaatattccatcgccggcatgactcccgcaacttctccgtttacaattacctgacttcctacatcggaggtcggttttaaaagaatcgggttcatataaacttccggccggatcatggcagcttctgcctgcatgacctgtgcgcgtcccatttccagaccatctgccgtgataaaagaattgagtgccatgttctgtgacttaaatggtgcaaccttgattccatcttcctttaaaacacgacagagccctcccgcaagaaggctctttccaacatttgacatggttccctgaatcataatcgactttgccatattaaaattctccctgacctgcatagagaatttctcccagcgcatcgatcagtttctggttgtctcctctctgccgcatacaaacacgataatatccttctccgagacctttgtaattgctacaatcccgaaccaggatcttctgttttttcagtttctcatataaatttataccgcttcgcatcagaatgaaattggcatctgacggataatgggtaattccaagcttgtctaattcattttccatccagattctttcacggttcgtaaaatcacaggtccgtttcacacgcatccgctcttttaaagatgccatacctgccgcctgtgccggtatcgatacgctccatggctgtctggactgttccatcttctccagaaattccatatccgaagtaacggcatacccgatacggattcccggaatcgcgtgcatcttagtcagtgaacggaggataaataacgttctccatctcttagtatctgcaagaatggatgccgtagctgcattttccgcgaaatcaataaaacattcatccaacaccatccggattccgtaagtctcgcatcttgcaagaatcttccaaagcatactccggtcgatcagctttccggtcggattatccggtgaacacaaaaataccatatcaatatcttcattcagaagatccagaaaatcttcctccagttgaaaaccagtcgcttctcttttcttataataacagatctcgcacccggtcgcacgcagtgcctgttcatattccgcaaatgcaggaaccggtatcagcgctttccttgggcagtccgcaagcactgccgtaaaaatcagatctgccgccccatttccacagataatatgttcagccggaacttccagtcttttcgccagagcacttttcagtttcctgcagctggcatccggataatttccaatctggtctattgactttcttgccgcttccactacagctcttccaggtccgaacggattcagattcacagaaaaatctgtcattcctttgtgtgtataaatatctccaccatgtacatattccataaccttttattccccttacatcagtatcatacaatatttcagtaatccaaagacaagaagtgtcagaagtgctgttccgtccatcagattaccggctcttaaaatatcttccggctcgataggacgcacatcatctccgattgtctctttcggatataattttccaaaataataggcatctcccgcaagctgcacctgaagtgcacctgcacataccgcttctgtctgcgcggaattcgggctggcatgctttcgcctgtctcttttccagactgcccacgcccttttataatccatccggaagatccatgcacttgcgatcatcagaagtgctgatatcctggacggaatataattccatacatcatccattttagccgcaaaccgaccaaaatgtaaatacttttcattcttatatcctaccatagaatccattgtattaacagccttataaaaaaatccaagtggtgccccaccgatcagcataaaaatgagcggtgcgatcactccgtccgatgtattttcggctactgtttccaccgctgcctttgtcactccggcctcagaaagatttccggtatctctccccacgatcatcgataccgcatgtcttgccccctccagattgtggtttacgagccgtacataaaccttcctgctttcatctttcaggcattttccggcaagaagctgataacaccagaaagtttccagtgcaaattgaagccagaagctgacctttccgacaagatacaaaagtccccacggaattccgaccgatgcaatcaccacaccaaaccataaaacacatcctgcgattctttcttttttctcatcatttttacaaaatccgcgcagccacttttccagtatcgaaatccagtttccaatgatccgtaccgggtggtaaagccataccggatccccgaaaatcgcatccagcgccattcctgctatacatgccatcaaagaactcatatttcctcaatctcctcaaactgtctctttccctgctgccatttttcttcctcaatttgaaaatgaaaaccttttccgtttttcacctgccagtgataaaattctttcttttccggatcaaatgcttccatcaccgacatgatcgtccccccatgaaccacaaaggcaatcttctttcttttttcctttatcatcttttccatcatctgttcaaatccgcagacacaccgtttccggaactccatcggatcttctcctcccggaaatgcctttgtacctccagaatcaatccagctctgatactttggattcccagtcagctcctgataattcttcccctcaaaaaggccaaaatcacattcccgcatctgctcacagacaacctgctctgctcccggaaaaagaatctctgccgtctgcctgcacctcctgagcggactgacaatcacaagctccggcttccactcctcacgtccattttcttcttttttcagagtatgctccagaacgaactctgcctttatttcttcatctgtcaccccaatataccgcttctccaaattcccttccgtcgcaaaatgccgaatcagctcgatttccatcttctatacatctcctcttcctttctctgcttttcatttgattccctgcttttcatttgattccctgcttttcatttgattccctgcacaatcaatcccccaactaataatgccagctcacaaatctgcagaaagtatcccgccagatccccggtaacacctccaaactgtttcctgctcatccggtaataatatccaaatactactcctgcaattataagaagtaccaccataccaaccggcgaacagaaatacaaatatactgccgccaggatcaggtatacaatcattgtgatccttactgcctttttctgtgctccatcctggaaagtctttacaagaccgcttcctcttgctgccggaaatgtcactacagcaatcccactgagcgctcttgaaattacatatcctgctgctactaccggaagcatctccgtccggatttcactccatacgccaaggcttacggtaaaataacagcagattccgatgaccgcaaaagcaccgttatgcgaatctttcaggatttccagtttcttttctttatctccccaggatccaagtgcatccatcgtatccataaatccatccagatggatccctccacttacaaaaaccggtatcaatgtcataaccgcagcaaacatcagtcttccactgtttactttcggaaaaatatttccatcaagaaacattcctgccagataaatgagtactccggtcacaacaccgatcagcggaaagaaacacatcgtatatttcatattttccttgttccactcaatgcgcggcatcggtatttttgaatacatagaaaacgcaacgatcatcggttctaaaaatttcatctttcgtccttcccatccagtacttcatactgctctacgtgaatatcatcaaaagttcccattttacggtacacctgaagtcccatctcaagaagcggcatcgctgccactgctcctgttccttcccccagacacatgccacatgtaagaaatggttttttttctaaagcatctaaaatctttcttgacgcaggttcatcagacaaatgggatggtaaaatatatcctgcacattccggaaccagccgtactgccacaagtgcagccactgcagaaataaagccatctatcagcaccggaatccggtagatcgccccaccgagatatacacctgcaagtcctgctatgtcaagtcctccaaccttagaaagtacatcgatcgcatctgttttatccggctgcatccgctcaaccgcttcccggatgacctgtaccttcttttgcagaccttttttcgtcagacctgccccctttcctgtcatgaccttcggatcctctccgagcaatacagagacaaccgcactgctggtcgttgtatttccaattcccatttcacctgtcgcaagaatttcgtatcccgcttcggcacacttctttaccatctgaatcccaacttctatcgccgcaactgcctcttctcttgtcatcgccgcttcttttgcaaaattgtgtgtgccatacatcactttgtattctttctttgtcacagacggcacatctgttgccattcctacatccaccgggaaaagatctacctttgcctcttctgccatgatgcagacgcttgtctctcctcttgtaaagttatccgccacgattgccgttacttcctgtccggtctgtgtcacgccttcttctaccacaccgttgtccgcgcacataatgatcagcccgcgctttcgcagttcaaaatctgaagtccccttaatcccggcaatctggatcaccgcatcctccagacttcccagactaaacagcggcttccctaccgtcatccagtgcgcccgcgcctcttccattgcattttcatcaagtggttttattttctctttccatctggtctcttccatctgtaagtctaatctcctgtcttttcgatttgtctttgtcagctttttacttgcttctgtaggttctacacgcttctacaaagcgtttggccactttggggttggaataaaagtataaatgcggaaatcccgcaaacagattccccttcatatgaacagcctgccattttctcacaccatccggctttacggcaagtgtatcctttccgttttccgtagaatcccaataatggaactcatgcgcccggatcttctctccctttttcatatacactccgttcatttccgcagtcagctcaatgtatccgaatctggtaagtcgcccttttttgatcccttttcccggaagtgcccccaccatcggatagtgctttccatcttccccttccagctcttctgtcaaatataaaaatcctccacattccgcaatacatggaattccattttcaatctgctttcttacatcttttcgcatagctctgttttctgccagatgtttcgcacaaagttccggatatccaccaccaaataaaagtccgtctaaatgttccggaagccttgtatcctccaaaggactaaacggaatgatctcacatccaagctcttttaaaagctccatattatccttataatagaaacaaaaggccaagtcacgcgctacgccgatacgcacttttcgtccggctgcttcctgttttgccttcaccggatgatactccatttcttttgcttcccaggcaattttcagcaccgattccatatcaagtgtctctgtcagaatctctgctgcccggtcaatctgtttttttaggttccctatttcctccggaagcatcagtcccagatgccgactctccagatgaaaagcatcctcctccggcacataaccaaccacctgaacctggaatcccattgtctgcaatccctcttcgatcatcttcttcatcttcggatacagcatcggggaaatccggttcagaatgattccccggatattactgtcattccggtattcaatcattcccttcaatactgccaggattgtcgatgccatacctcttgccggaacaaccaggattaccggaagtcccagggttctcgcaacgtcataagtacttgcctgatccgaatccagactgatcccgtcatagtaccccatcacaccttctgtcaccacaagctccgcaccttccgcatgatgcataaaccgctctttcaagcgctcccggtcacaaaaatacagatccaggttctcggaatcaattcccagcacctcccggtgaaacataggatcaatataatccggtccgcatttgcaggcgcgtaccttctttccggcatttttaaatgctttcatcattgccattgtcaccgctgtctttccactcccactggcagatgccgcgattacaattccgggaattttcattctgtatctcctccatctgaaataatataaatcggatttaacccggtcatcatgtgatatcttccaagtttctttgactttgccacattcagttgtatgatttccggatctgcaagcagtccttcctccatcgcctccatcgcttccttcacggtttccagcgaaattgcattgatcacgatacggacgtccggattttttttctttatgcactgaataatttcttttaactgtcctgtactgcctccgataaaagcatgggtcggcatttccagtgcttccagtgcctccggtgcaactccttctataacctgaatctggtctgcccggaatttctgcatattcttcctgatcagttctgcaccctccggattcttctctattgcataaacgcggagattctctccctgaagagcagcctctatagacactgaaccggttccggcccccacatcatatattactgcattctttgtaagcttcaattttgcaatgctgactgtccgcacttcctccttcgtcatcggaacacttccacggatcagctcctcatctgcaagatgaattcctgttctcttttccggctttggattctcgatcaaaatagtggtaagatcaccaaaatcttctgcctgaagctcgtttccttttttgatcacaatctcttcatccggataagacaaatgatttccaaccgaaacggttacttgttccagatggtaatatttcagtttttcgcagatctcttttcccgcacttttcccaaggatcagaaatgtcttttcatggtttgcaactacatggataaaattctgacttcttccatgcatgctgagaatcttcgcatcctcccagctttttccaagctttgccgcaagatagattacagatgaaatccccggaaaaatctgtacttcatatccgtcttttttcagaatatccgccagcttttttgccccgctgtaaaatccggtatccccggaaaacagcaccgtacatctggtcttttcctcctgctcatccaggattgctctgattttttccggcagatactctgcatagcagcatttctttttttcccggaatccttccagcatccgcgtagctccgatcagcacatcactttcctcaatgatctttctgacctcttccgtaagcgttcctttgcttcccatcccgatcccggcaagatttacctggcattttcggttttccacagttattcctccaatcgatagcctctcggtgtcaccattttcccatccacatttctcgtctggctgttgccgatataaacggttgtaaacatatcgacctccgtatccttcagctcagaaagtgtcagaatatgtgcatcttcgccttcacgtccgatgttccgcacataaccgcagactgtatccgggctctggtactccaggatatactcgcatgcctttttcaggtaatctgcccgtttccggctggacggattatacagacagatcacaaaatccgccatcgcagctccgcggatcctcttttcaatcttctcccacggtgtcagaagatcactcagactgatcactgcaaaatcatgcatcagaggtgcaccaagaactgccgcaccgccatttgccgccgtgatccccggcacgacctccagctccacctccgggtagccctgtcccatctcatagagcagacctgccattccgtaaattccggcatccccactgcataccatagctaccgtacttcctttcatcgcctcatccattgccatctcacagcggatcacttcctgccgcattggtgtggaaaggtactttttatccggaaacctttcccgtatcagtcccgtatatacggtatacccgataataacctcacttttttccagtgccgtggacgcctggtatgtcatttctttctcagcacccggtccaagaccgattacatagacttttccaattttacacatttcctgcaccttcttttcctttgccctgcctgaactctgttgtaaactccggatgatataaaagtgaccgttcatactctccgccaagcacctcaccaaccacgatcagtgctgtctttgtaattccattctcctttgctgtcaccgcaagatctttcaccttacatctgcacaccttttcatcctcccaggttgccttgtagacgatcgctgccggagtctccggctgataaccgccttcgatcagacgcttcgacagttcttccagcatcccggtacttaaaaagattaccatcgttgcctggtgcgcagcgaaactttcaatggattctttttccggaaccggtgttcttcctgccatccgtgtgatcaccacagactgtgaaatcccaggaagagtatattctgcattcagtgcagatgctgctccgcaaaaggagctgactcccgggcacactttataagaaatattctccttttccagcagatccatctgctctttgatcgcaccatacagacacggatcacccgtatgcagccggacaacttttttctcctgcttctctccggaaatcatcacttccatcacttcttccagcgtcatcttcgcactgttgtatatctgacagtccttctgacaattcttaagaagctccggatttaccagtgaaccggcatacaccactatatctgcttccttcaaaagcttctgcccccgtactgtgatcagatccacagcaccgcttcctgctccaacaaaatgaatcatttttctttctcctttgctattacaatcgaaaaatatcccgcatcttccggtatttcttctgtgcatttgtaaattttttctccatccattccgcagttcatgaccattttcgcctgctgtccttcctctttcagaacagctttgaccttcgccatcttttttccggtcttcataagaaccttcgtccccggaagcttcaacttttcttcaattccataggacaccggaagaacatgcagctcctgccggttctccacaagcgagatctccagccttgctgccgcagcacaaaaagacggaatcccggaaaagatctccccctgatatcccatctttttcagtcttttataaatataaattcctgtcgaatacacagtcggatctccaatcgtcagaaaaaccagattctttcctttctccagaagctctgacgcctttcttgcacctgcatcgtgtatctctttcagtagctttttttccttgatcattggcatgggaagatacagccgcagcttctttttcgtctccggctctgcctcacacgcaatccgatatgccagacattcttttgcaaatgtctcttcttccccctcttccagttccggtttctttaactccggactgccaattggaagtaccaatacctgacacgccttaatcgcacgaattgtctttatcgtcatcagttccggatctcccggacctacacccgcaaggtcaaatcttcctgccattttttgtcatacctttctaactatccaatcttttccctcagtttgtccacaagagatgtcttcccaagaaccccgagctcatccgaaaacatcagcgccccgaccttcatcttctcgcctgcacgcttcgccaaatgatactcgatcttctccatcacggtccgcatcgtctcttccaaaagtcctcttttttccaaaatgtccaatgcttccttcgtcgtaaaacacttcatcagagcacagactgtctcacggtctgcccctgccattgccgcatggacggcaagcacttccattcttgcatctgcctgtctggaatgggtattcattacacctgcagcgatcttgacaagctttccgatatgtcctacaagcagcagtccgtccatcttcagccgcacgccgtcatcaatcgcatccccgatataattgctgcatttcaccgcaagctcctggtcgtacccaagtgtctgccttaaaaaatcatttccataatttcccggtgtcagataacaataccggtgaccttcatcacgaagcatcttcatttccaggaaaatagtctgcgtcagtgcctgttcactcatcggttctacgattcctgaggttccgagtaccgaaatcccaccttcgatcccaagtcttggattaaacgttttcttcgcgatctccacgccctgcggaacatagaccagaacgtctgcgccaccatcccagtcatatttctcaatctggctttgcaccgcttcccggatcatctgccgcggaaccttattgatcgccgcttccccggcttcctgctccagcaccttccgggtgaaccgccctactccgatcccaccatctaaggtcactcctttttccctttttttcgtgaccttggcgtaaacgaagatcccgttcgtcacatccgggtcatctccgctgtccttctgaatggcacagctgacagattcattttctctttggatcttttctacttccagatacagttcgatccctttcggcgtcataagagatacctggcggatttcctccccggaaaagagcattgccgctgccgcctttgctgctgccgcagcacagcttcctgttgtatatccacaccgcagttctttttgatttttccacacgacctgcatcttgtccatttccatttcgtctccttagtattcgatgcctttccttgcccggattcctttttcaaaaggatgccgtaccatctttacttccgaaatataatctgccagctccagaagctcatctgacggatcccgtccggtcagaaccacttccagattgtccggtctgtcttttaagaactgcaccgcctctttattcgggatcagtccataccggtatgccgccataaattcatcaatcacaagcatatcataatcccctgtactgattttcccccggatcgtattccacagcctgccatacatctctcggacttcttcctgttccttttcggaaagtgtcttaaaaaatccatagcttttttccagatgaagtacctcgatctccgggatccgatccaggatcttcaattctcccgaaaattcattttttaaaaaacgggcaaacagaacccgcataccacttccagctgcgcgaactgcaagccccgttgccgccgtcgtctttccttttccatctccacagtaaatgtgcaaaagtctatttttcatatgattccagctttcccatttcttctgcaaatacaagcagttcttttatcttctggttggttgtcccaatcacaattcctgcatttatcacctttttacactgcctgatcatctgctttgcccgttcaaatgcacggtcgcttaccggttcaaatggctcttcttcgattacactgactgccagatgttctgccagatgatagtcaatatcattagtatacaggattcctgccgaaaatggaatctttgctttctgaaggttccggtaaacagggattccactgcctccggaagagatcacaaatacttctgcctctccctctgcctttgcaagctccacacttccgaacacaggatcaaaatgcccgttgtcgatctcataaagtttctggataaaatcttctttaaaaatcgcctccggctctccataaccgaaaattgtatctcctttaacgcacaggatcttatccgagatcttctgcgccagatcgatctcatgaagtgacataatgaccgtgatctgcttttctttcgccatatttttcaaaatagtaagcaactccagcttataacggatatccagaaaagaagtgggttcatccaggatcagtacctccggttcctggcagatcgctcttgccagaaggatccgctgtctctgcccgtcactgattgcctcaaaacttttttctgcgtattctgttgcatggacaatttccagtgcttcctgtgtctttttctcatcttctcgcgttaatatcccgagccgtcctgtataaggataccgccctgctgctacgacctcatagcaggtcatcagctccggctttgcccgctgtgtcagcaccactgccatcttcgttgcaagctctttgtaagataagtctttcagattcttttcaccgatcgtcaccttacctccaatgagcgtaagctgtttggtaatactttttaaaatcgtagatttcccggaaccgtttggtccaatcagtgtcaatatctcaccttttttaatctctgtacagatatcatggatcagtacatttccatgatatccgacagaaagatctttcatctgaaaatagttctcactcatatttatttcccttttcttccttttatcatcatgaaaattacgatcggtgcaccaaagatcgaagtcacagtactgatattcagctccagtggtgcaaatgccatacgcgcgatcagatcacatcccatacagaacaccgccccgccaaggaatgttgccggtatcacaaccagcggttttgccgtcccgagaagatgcttgatcaagtacggaactgcgattccaacgaatgaaatcggtcctgcaaatgcggtcacacatgcggaaaatacactggaaagcagaatcagaagcacccggaacacacggatattgacccccatactctgcgcatacatttctcccagctgatacgctccgatcggctttgacaggaaaaaggtaaggatcagtgtgattcctaccataagcgctgctacctttacattgctccagctcataccggaaaagcttccctgtgaccagccatgcagattcacgatatctgaatcctccgcaaaagtcactacaaaatcagttactgccgagcagatataaccgatcatgattccgccaaccagaagagttgccatattccggatttttcttgcaagaagcaggataaatccaattgaaagcatagatccgataaatgctgcaatgatcagtatataagatgataccaaagtgtaatattttaaaaagatgatcatcgccagagcgaccatcatctttgcacccgaagaaatccccagtacatacggtcctgcgatcgggttggaaaaaaatgtctgcaataaaaatccggaaagggcaagtgcccctcccagaatccctgccatcaggacacgcggaagacggattttccagataatattcatctgcacctgtgttccttttttcagaaacaggatccgtaaaatctcaggaaccgagatctgtacatttccggtattgatgttcagcactacgatcatgcaaaaaactgctgccagcaccgcaaagactcccatatatcttgtattccttttccagttatttttcattcctgcctgtcccattttcttctccgttttctattttacatggtataaaaatgtcatcttgctttcatcgccgcctgtcagcatcagattcatatccgtgatcagttccccgacgatatcggttgcctgatacagatatttaccggtacaccatacatttccttctttgactgctttgaaatcagaaaaaagtgcatctttttcttccagatcttttacactgttgattggattatcgatacttgaattataaatcagataatctgcatccgccgcctgtgcgtaaaattcttccattgtaagttttactgctgaagtattactgtcatcgccagtcagatcatcgaatacatatcttccaccggaaagttcgatcattttcggaatataatcatcacttcttcttactaccaccgttccgtcactgcttacatagaaaaatgcaactgtcttctcggtattcttaaaatctttgagcgcatcgacattttccacctgcttttcaaaaaatgcatccgctgcatcttctttattcagcattgctgcataaagtttgatccattcagttcttcctagaggatgcgattcatagctggaccggtcgatcatcaccgggatatccagagattcaatcatctcctgtaccttcggtgtgtgaaggatcatggtcgattcgatggcaagatcacagtcttcgtccaccagcatctcataatccggttcactgtatttccctgcaaattttattttcccgtcatccatcgctttgactgcattttcaatataccatccggaagcctgggtacctgtcattgtgatattatccagagaatcgatcgcattaaaaagtgccattgcagatgtcgccgcaagataaatatgatccagcggctgctgaaggatcacgtaatcctcctcggctccatccggcacatcctgattttccgggacgaccagaaattttgcatcgtctttgatatcgatcatcttatagccgtctttgtagtaatatacctgaaaaccttcggcatattccagatccatcgcggattcataagtgagtccgtcaatctccggaccttttttttctttggcactttctttcgtactgctgctttctgttttttttgtatctgttgtattctttttcgtctgcccgcatccggtcagtgctgccgtcccaagcagcactgtactcaaaagaatgcaccccagacgcatcgttctctttttcattttctacctctgtatccaaaaaagaatctacctagttttttgcagaagaatctgtactgtctgtctgcgcgaaaattgcctcgtaaaccttgctccactctgcttttgcatcatccttttcctcatctgctgaccggtcaacgatcatcggaacatccagaagaacaaatttttctgccagctcttcgtatctcttctgctgatcttctaccgacattttcttctcattcttttcatccggaagaattttattggaaaggattgcaagatcacacttactcttcatcagttttttattttccggtttcttataggttcctgcatagatgatcttcttagctttcattgcttttgcaatgccttctaccttacagttcttctgttttacccctactgatgtaatctggtctgttgcattcagcttatccaggatttccagtacttcctctgaacctacatatgcagacttcttcggcttctggatcacgatcatttctttatccagacctgccggaatttctgcatcttccgggacgatcagataacggacgatctttgctttgtaaagcgcaagcttttcttcctgtgccggtgtcagtccggaatctgtatcttcttttgtatcctttgtcttggtctcttttgtatcctcatcttttctctgatcgatttctaaaagagtgattccctgatcataatgatagatcttgaagtactctgcatgctctacctttgtctcagactgataagaaagtcccatgatttccggcgctttctcatccagtgtatctgcacttaaattggtctccccacttactgtagttccgtctgcttttgctgcagcacttaggtaaatgaaaatcgaatagctgatttcatgcgctgttgacatcttggttgtcataccgatgatcgtattgttcttgttcagttctaccggaatgacaaatgtagacgtacttccggttgctgtcggataataggtatttccattcgcctttacatagccataagaaccactgctaaatacaatggtagcatatgcctgaccgcctgtcacggtaatcttggtacaactgatgctgacctttccggttccacctgaccaggaaaatttatccggtgtatagacaccgtctgcaagtgttgttgcactgtttacacgggcagttccaccatttaaatctgcctcgtatttggattctttgtccggggtctggtttgtgcctgtacctccggaagtggtgccggttccaaagttggtgttctggctggtgttatttccctggttggtgttgccattatttccagtagttccatttgtggaattgctattgttcagattcttcatgcctgctgaggcgaatgtcaaggtacggtcataccatacttgctttttatgagaaaatgctgccactgaaattcctgtgtctaataaagaaaccggaatcgtataggtatacataccatttttgtccacaacataaggaatccacttggacttatctgcaagtgctgcttctgcacttgttcctacatacagataatcatatcctgtaccactgagtgtaatttttgcagtcatctccccattttttgatgttaagatgcaatccgtaactttaaacatggatgaacttgaagttacgtttgctttataagagccatcacttacctgaacatatttggtcattccttctgtcttgaatattaatgtacgatcataccagttaccactattgaatccatgtgctgcaatctggactccggtatccatactttctactggcactgtaaatacatattttccttctgcatttacagaatacccaatcagttgatcttccgaagcacttgccgcagcttccttacttcccatatataacttatcgtatcccgttccactaagtgtaatatctgcctgcatcttgccaccaacagatgtcagcacgcaatttactacacgaaacattccactagctgaagctgcatcaacatctactacatactttccagtatccagtacagtcttgtcctcatttcccggtttctggttttcgccacttccggtttccggtttgctctctcctaaattgcccccctgttcaggattttctgtgtcgtcttttttattttctgctgacgatgaaatatgaagcgtgtaatctccgtctgctttcctactctcccagccgttctcttggctatgtggtacaaaggcaacatcccttccatctgctgacagtggaagttcaaacgtaaataaataccctttgcttgttcccgttccaactatcgccttttcttctttccgttcaactgtatcagctttacttccaatataaattttattgtaagttttactctctgtttctatcgaaactttcaggtgatcattttcttttacaacagaagacgatccaaccttaaacattgcaaaatcactggtaacatttttcgcttcctgcgtcttcacttccccggcattttccgccgtttcttccgacttaaccttctgctcctctgcagctttctcttcgctctttccgtcttcgcccgcttctttcttctctgcctcagttacattccctgttgccgcattttcttctgctttcggctcttcctgactcttctgattctcgtccgttccctgtccggcagtcgtttcttcttcctgtccagtcacttcttcagccagctgacctgctgcgtctgccgcaccgatttttccgtctgttacttctacggtctgctgacctgattctgtattttctactcctgccactgcactgtcctcagcgtaagcataagaaaccggtgtaaccgacattgcaactgccatgaaaagtgcaagaaactgttttgaattcctcttcataatccaactcttcctcctgatgtcctgatcttttgtcgcttgacagctcgatgatgtacattcgccaaatttagtttctcgtgcaagcataaatctgcacttggctcatcgtatgcaaaaaaaatctgcttccttttcctgaaagcagacttcacctacatcctctgccacaggaactcttttccgtatatgtggcagcacaaaaatcttgctttcatactcagtatgaagcaagatatcatttctttatgtatgtaaacgcgctttcatcggaagcaatttactctctttcagcaggtctcctggcttatggatcttaacaaagctgcaccttctcacatttttatgcaatggcttgccgccgctttgctcctcatttacagtgaccggatcgctcaggactttcacctgattcccttttaagccgaccagaaattcttctgcctagcactgaaaaagtttctttatttattcttactcactataacagatatgtttcttcttgacaagagtcatctttccttgtttatttccctattttttccaaactctccattaaaaatcccggaagtttttgtttcaaaatcgacaccttaatgactatatgtttatcataatttcatgacctacttcatttatatatagaaagcgaaggggatcgaaatgagaaaaaagtgccagtgaatgtatggaaatactctgaaataagacaatgcagccgccagatcgacgactgcattgtcttatactctttttcgtacaattttattttttcgctgcctcaaaattacgatgaagtaattcgtgggtctttcctttcagaagttcatcatataatgacaggatcagcggattctcattcgacttcttaatctgcgtattgatatcggtatcatacaggcctttgcttctggctatcctgcttctcggacctgccgggactggctgtccgccacccatgatacatccgcgcctgcatgccataacctcaacaaagtcgtaatgtacctcgcccttctggatcttcttcatcagcgcatctgcatttccaagtccactgacaacagctgcatggatagtacgtccgttgtaatcaaactctacttctttcagtccttcttctccacgaactccactgaatttgatcttatccatttccacacggttatgtccttcacgaaggcgcctgagtacggcttctgtcacaccaccggttactccgaagatcacacctgcaccagatccgataccaaacggcatatcggatgcttcgatctccagattttcaaagcggataccggatttccggatcattgtaatcagctctgttgtagtcagtacataatcaatatcctgttttccattcgtggaagattccggtcttaaaatctcttctttctttgcagtacacggcatgatcgatacagaaacgattctctttccaccattcttttccggatccttatagtattcacggatcacagcaccaaacatctgctgcggtgaacggcaggttgacagattttttgccagatccggataacggttctcacagaattttacccatgccggacagcaggatgtaaataatgggagattttctccggatgcaagtcgttcaagaagctcttcagattcctcgatcaccgtaaggtctgcaccataagaagtatcataaacttcatcaaatccaaggcggtgcaacacattgacgagttttcccatcacattttcccctcttggaaggccgaactgatcgccgactgcgacccggactgccggtgcgatctgtgcgatcacctttgtattcttatctgcaagaaaatcccagatcacttcgatattggtattgatactgatcgcacctgtaggacagacaaccctgcactgtccacagtttacgcagtctgtctctgcaatctttttgttaaatgccggtgttaccagagcctttgttccccggtatgcaaaatcaatcgcattaacagactgtacattgtcgcacatacggacacagtcaccacagagaatacatttattcgggtcacgcacgattgacggtgaactgaaatccagtggatactgttcttttgtattttcaaatcggacggttgtgacgcccatacggtgtgccagcgcctgaagctgacattctccactcttgatacaggttgtacagtctctgcaatgtgcagcaagtaaaagctccagaatcatcttacgatatttcataagacgcggagtattcgtgtaaatgaccatcccatctcttggcggttctgaacaggatgcaaacgtctttcctctctcatcttctacggtacacaaacgacaggctccatacacagacagttctgaatggtagcagagtgtcggtatatctatatctgcattacggatgacagaaagtacattcggctcatctgtaaactctaccttccttccatctattgtcatatatcccatgactcattcctcctatttctcgatatgaattgctttaaacggacactgttccatgcaggctccgcacttgatacatttctcctgattgatatgataaggagatttcagcacgccttcaattgcacctgccggacagtttcttgcacacttcgagcagcccttgcatatctccggatcgatctggaatttacgcagatttgaacagacacctgtccggcagcgtttctcgttgatatgttccagatattcctcttcaaatgcattcatggtactgataaccggtttcggtgcgctctttccaagtccgcaaagcgccgtactctcaatcatatctgccagttcacgaagctcgtccatatcggatggtttcccgtttcctgctacaatacgctccaggatttcaagcattctctttgtaccttcacggcaaggaacacattttccacagctttctctctgtgtaaaactcatgaagaatctggcaacctctaccatacaggtatcctcgtccatgataaccagaccgcccgaaccgatcattgccccgatcttcgccagtgaatcaaagtccatcttactgtccagctgatcctcggtcagacatccaccggacggaccaccaatctgtactgctttgaatttcttgtcattctggattccaccgccgatgtcataaataacttcgcgcaatgtaattcccattggtacttcgatcagtcctgtatttcttacattaccggtcagtgcaaatgctttcgttccgggactctctggtgtaccgattcctttgaaccagtctgcaccatttgttacgatcatcggaacattggcataggtttctacgttattaagaacagttggtcttgcccataatccctgctctactgtacgtggcggttttactctcggcattccacgttttccttcaatggatgccgtcagtgcgctgccttctccacagacgaatgcacctgcaccacggttgatatgtaaatggaaactgaaattggttccaagaatgttgtctcctaaaagtcctattgcctccgcctggctgatcgctgtcttcagtctttcaatcgcaagcggatattctgcacgtacatagatatagccttcctgtgcctgtactgcatatgctgcgatcatcatgccctcgatcatacggtgcggatcaccttccatgatacttcgatccataaatgcacccggatcaccttcatcaccattgcagaccacatagcggatcttttctttctgggaagcaacctgctgccactttctgccggtgcggaatccggcacctccacgtccacgcagattcgaatcatagattgtctggatcactgcttccggtgtcatctcaaagagtgccttttcgattccggcataagcaccgactgcaagtgcacccccaatatgctctgcgtcgatatgtccgcaattcttcagtaccagtctggtctgctttgcgtagaacggaatctcttcctgtgacggataggtcactccatccatcttgtagagaagtcgctctaccggtctgccgcccaggattgtttcgttataaatctcttcgcagtcttccagttttactttaatatataaataattatatggctcaattcttaccagaggtcccatctcgcagaagccatgacatccactcttcataacctttgtatgtgcgatttcttccccgatctttacttctacccctgtatgatcttttgtcagttcttttaacttttcataaatcttgcctgatccacttgccagacatccggttcccccgcaaaccagtactctgcagtcagccgattgttttttctgacattcaatacgatattccttcagttccgttctgttttcaattttcattttcttcacctctcagttcttcaagaagtttgattaccttctccggtgacatcttcggatgtacttcatcattaactgtgatcgcaggtgcaagtccacaggctccaagacaggatacagtctctactgtaaaaagcatatcgtctgatgtatgcttgtgctcatttaaccccagctctttatacagcgcttccaggataggaatggatttacgcacatgacaggctgttccgtcacagaccttgatcacatactttcctttcggttcaaatgaaaaattctcataaaagcttgccacactgtacgcttttgcctctgtaatcccgatctgttttgctacataggtaagcagttccggtggaagataacggtattcctcctgaatatcctgaatgatcggtatcaatgagcgttcctcccttgtatgcatggcaatgatctcatccgttttctgataataagatgcatctaacattccatttcctccttcgtcatattgtacatttccttcttattattctattatttttatgacattataacatatatctatagttttcgtttatacgtttcatatatgatagctatatattttccaatatataataatacaagaatcaaaagtattagtatttatgaatagacggataaatgtgtacccagctcatcaaatacacaaaaagagcagaatggatatatcttggtccgatatatcattctgctctcatttacatcatttcacggattgtttcttttaaatgcccaataaattctctttcgtacaattttttctgataaccctttttgtagatcagcacatcccggatcatctgtctggaaaatccggcatgcttctgcaccagattgtagtttttccttaatttttccggtactggcgatacccacatataactgttttttacttccaatctgatcgacacaggatctcttttgatcatcgatgattgctacaacgctaatccggtttccatgaaatcttctctggatgtactttctaccgcaacaggaagaaccgtagctgtaatgggcgatatgtatgagcttggtgataaggagaatgaacttcactacaataccggcgcacatgctgccgagatcggcattgatgtgatctgctgtatcggagaactttcccaccacgcatatgaaggtgcaaaagcctgtgcaaagagcagtgccgtactttactttaaaaccaaacaggacttcctgggaaaaatccggaatgttgtcaaaaaagatgataccattctggtcaaagcttcccacggtatggaatttcctgagatcattgatgtactcagacagatgaagttttaagagaggtaagacatgaaatatcagatacttgttcttgacctggacggaacacttaccaactccaggaaagaaatcactccaccaacgttaaaggctctgatcgagatccaggaagccggaaaaaaagttgttcttgcaagcggtcgccctacatacggcgtggttccccttgccaggcagctccatctggaacgttacggaagctatatcctatccttcaacggagcacggatcactgactgccgcaccggccaggtcatttacaacaaaacacttccgcaggacgtgatcccggatatctaccggatcgcttccaactacccggttgatattctggcttatgaggatggacagcttctgtccggatttaccccgacaaaatattccgaattagaatcccggatcaaccatttaccaattgtacaaattgataatttctgcgagaaagtatccacatttccaaacaataaatttctcctgaccggagaaccagacagcatcgctgctgctaaagaggaaatgtccgctcatttccatggttatatcgatgtttactgttcggatccatttttcctcgaaattgttccaaagaatgtagacaaagccacctctcttctgaagcttcttaccagcatcggtctgactgctgatgaaatgatctgctgcggtgacggatacaacgacctgactatgatcgaaaccgcaggtcttggagtggcaatggaaaatgcacagccactggtccgtgaaaaagcagattttatcacaaaatcaaatgatgatgacggagttctctatgtgatcgatcagtttatgcgcgattgaccatcgtagaaatatcatttctcaaaatataaaaatcccggagaactggttttacttccagtctccgggatttttgttttcagtatttttctgtacttagatttctgcagtttccgcgtcgtcagtctcttccagtacttccgcatacttgtccagaatgatcttctggattctgtctcttgtaccggaattgattggatgcgcaatatcacgatattccccatccagtgctctcttactcggcattgcaatgaaaagtcctttttccccttcaatgactttaatatcgtgaacaacaaattcttcgtccattgtaattgatactactgcctttaattttccttcttttgctactttgcgcacgcgtacatctgtaatctgcataactttctagcccctttctccagtaacgcacataccggtccgctccttttcctttatttgaccggcatgccttctgatccggactcttacaagtccccctcagtttttataatgcgtacctttcgttcttttctattactactttcacgccatcttcaccaacatgccgtgtattggcacggatcgtatccctgctctctacaatacagttctcaatgtaagtattgtccccaagatacacatcatttaaaataattgagtttttgatcacacaattatttccaacaaacacttttttaaacagaaccgaattctcaacggttccgttgataatgcttccgcttgccacaaggctgttcttaacgaccgcacccggattatattttgccggaggcagatctgtcaccttggaataaatacttggaagctgcttaaagaaatagttccggacttccggtttgaggaaatccatgtttgtcttataataggcatcgaccgtggaaatattgctccagtagtcttttatcttataaccgtatatctttttcagattcttgtatctgatcaggatatccgttacaaaatcatatctgtcttcctcagctgaatgctcgatcagatcgatcagctgacgtctgcggatgatatagattcctgtggaaatcgtgttggaatttgccaccatcggtttttcctcaaaatcttcgatccgcatattctcattcatcttcaggatgccaaaacgggttgcatcctcgccctgatccagatcccggcataccacagtgatatctgctttcttggcaatgtggtattccagtactttgttataatccatcttgtaaaccgcatcaccggatgtgatgatcacataaggttcatggcacctcttcaggaactccaggttctgatagatcgcatctgccgttccacgataccagtagccattgtctgcggtgatcgtcggtgtaaatacataaagaccaccctgcttacgtccgaaatcccaccacttggaagaattcaaatgttcattcagtgaacgtgcattatactgagtaagtactgctaccttctggatgtgcgaattggacatattgctgagtgcaaaatcaattgcccggtagcttcctgcaatcggcatcgctgccactgcacgcctctgtgtaagctcccgcatcttgttgttgttaccgcctgctaaaatgattccaactgctctcatgatctgtcacccgcctttatcaatactccgccgctttcaagagcaccctgtacataatcctccttcacggtaataccgctgatcgcagtattctttccaatctgtactcctgccggaatcacagaattctcaccgatcgtaaccagtccggaattgtagatatcagacctgagcttgttcggtgcttcattgccgattccaagggttacattatctccaaccttaacattctccgcaatgatcgctttgtcgatcacacagtcatttcctatcgcaacatcctgcatgatgatcgaatcccggatcacgcagccttgtccaacaacaacacctgcaccgatcacacagttatgtatctcgccgtatatctcagctccgtcgccaatgatgcttctgtcgatcacagcttcttttgagatatactgtggcggtataattgaattattcgtataaatttcccagaattcctcataaagattaaattcaggaataatgtcgatcagttccatattagcttcccagtaagaactcaatgtaccgacatccttccagtaaccattatattcatatgcaaacagtctctgcttcttttcatgacagtacggaatgatatgctttccgaaatcacatcccggctgatctttcatcttgatcagtgcctctttgagcaccggccagctgaaaatataaattcccatagacgcaagattgctccgcggattcgccggcttctcctcaaactcggtgattctcttgtcttcatcggtaattacgattccgaaacgacttgcttcttcgatcggaaccggcattgccgcgatcgtcacatctgcatgattctccttgtgaaaatccaacatgacctcgtaatccatcttgtaaatatgatctcctgataagatcagtacataatccggattaaatgtctccatatactccaaattttgataaattgcattcgccgttcctgtataccattcgctgcttgtactcttctcatacggcggaagaattgacacccctccgatattccggtccagatcccacggaataccaattccaatatgtgtattaagcctgagtggttgatactgggtcaggacaccgactgtatcgattcctgagttgatacagttactcagcggaaaatcaatgatcctgtatttgccgccaaatgcaacagccggtttagcaacttttgcagtcaggacgccaagtctgctgccctgtcctcctgccaatagcattgctatcatttccttttttatcatgtcttcaccccttctcagtaattctggttttttcattataacatattacatacatatagtgaacatattttacaaaaatatttctgtttacctatcttttttatagaaatatcacaaaaagaaaaggtttggtttttgacctatctatgttataattatgcacgtaagtcaaatactatgaaacaaattcacagaacaggaagtgtcattatgtataaaattgattttaatcagccttgccatatccacttcatcggaattggcggcatcagtatgagtggactcgctgagatccttcttgaagaaggcttcacagtatccggatccgataacaaagaatcggcacttacggatcatctgtctcagaatggtgcaaccgtattttacggtcagaaagcttccaatattatagacggtatcgaccttgtagtttataccgcagcgatccacgaagacaacgaagaatttgcagaagcaaagcgtcagaatcttccgatgttatccagagcagaattactcggtcagcttatgactaactataagacaccggttgctatatccggtacacacggtaagacaaccacaacctctatgctttctcatattgctcttgcagcagacctggatccgacaatctctgtcggcggtatcctgaaagcgatcgaaggcaatatccgtgtcggcggacctgacctttttattacggaagcatgcgaatataccaacagtttcctgcactttttcccgaaaatcggtattattctgaatgtggatgcggatcacctggacttttttaaagacctggacgatatccgtaattctttccacctttttgctaagcttcttccggaaaacggaactctcgtcatcaacggagatattgataaaattgaagagatcacctccgatctttcctgtcgtgttatcacttttggcaaagaagcttccctggattacagtgcagccaatattacttataacgaacagggcaatgcctctttcgatgtcgtaaaagacggacagaatgttgcacatctcgctcttgcagttggcggtgagcacaacgtatataacgcacttgcggcaatcgcagttgccgatattcttggtgttcctgcggagacgatccagacaggtcttgcttccttccacggaacagaccgccgttttgaatacaaaggtgaagtcggcggagtgaccatcattgatgattacgcacaccatccgacagagattgctgcaacgctgaaaagtgctgcacattatccacataaaaaactgtggtgtattttccagccacatacttatacacgtacaaaagcattattctcagaatttgctgaagcactcgcacatgcagaccatgtaatccttgctgacatctatgcagcgcgtgagacagatactttaggcatctcttctgcacagcttgcagatgcagtcaaagaacatggatgtgacgcaacttatctgccaagctttgcagccatcgaagagttcgtcaccacccattgccagcctggcgatcttctgatcacaatgggtgccggagatgttgtaaccattggagaagacctgttaaaagcctgattttctccaatatttgcgaaattttatctgtaataacaaaaatttccgtcagaaaattcttttttacaatctgggatgatgttataatgaacaaagtcagaaaagaaaggaagcggaaattatgagtgcacttattttgcgcaatcattcccacaataacataacgatcgtggagaatgactttatcgatcattatatggtatctgcgaacggagaatatgtaaaagtctatcttcttcttctccgttatcagaatatcccggagcagcttccggatatcccgcagatggcagaccttctggagaataccgaaggcgatatcctgcgtgcactcaaatactgggaaaaagaaggaattctttctctcgaatatgacgaaacaaatgaactcgccggaatctgtatcggaaaagcaccaactcatcagacacctgtcaaagcggctttccatacaccttccgcacagtctgcttccgttcatgaaaaatctccggtcgcgcagtctgatggaaataccactgtttcagacaaagctgccggtcagaatcttcctgcatcaagacgttcccttgctgcaagaagagaattaaagcagattctttttattgctgaacaatatcttggcaaaaccttatcccgtaccgatgttgatgcgattacctacttttatgattcccttggtttttccgcagacctgatcgagtatctgatcgaatactgtgtggagaacggacataagagcatgcattacattcagaaagtagcactttcatgggcagatgaacatattacaaccgtcgatcaggcacgtaattcctctgcattttacaacaaaacctgctattctatcctgaatgcatttggcatcaaagggcggggacctgcatctgccgaactggattatatccgcaaatggctggaggatgggaatttcgaactggatctcattctggaagcatgcaaccgcaccatcagtgcgatccaccagccaagttttgaatatactgacaagattctcgaaaactggaagacgggcaacgttcgtacactggcagatgttgagcgtcttgattctgcctttgagcaggaaaaagaccggaggaaaactccttcggggcaaaaccgtacaccttctgcccagcagccttccaaattccgtaattttgaagaacgttcttacaatatggacgagcttaccaaagaattattacgcagtaactaagaaaggggaacactgtgccgttaactaattcacaatacaatgcgctgatgcgcgtatatgaagaaaaaagagcgaagagccgcgacctcgcgaatcttcactacgagcgtgcctgccagaaggttccggagcttgcatcgattgatgcctctatttcttctgccagtcttgatcaggcgaaaaagttgctcgcaggcgatgacactgccctcgcttctttgaaggaagatatccggtctctttctgacagacgccgccgactcctttccgacgccggattcccggaagactatctggaacagcattttgaatgtccggactgtcaggataccggctatgtcggcacgaaaaagtgccattgctttttaaaagcgatcattgatctgttctacacccagtccaacttaaaagggcttctcgaacaggaaaattttgaacattttaattttgattattattcatccaattatagagaccggctttccggtcagaattcccgcgaacttgcaacgcgggcttatcaggaatgtatgaatttcatccacaattttgataccgaacatggtaatctgctcctttttgggaatactggtattgggaagacatttctcagtcactgcattgcaaaagaagtgatggattctctgcattctgttctttacttgactgcctctgaatttttcgatgcgctccttgaaaaagcactgacccggaatgatgagagctgtcttttatatgagcagatccaccagtgtgatctgctgatcattgatgacctgggaaccgaacgaaatacagactttgtcgtttctcagctttttgtgtgtttaaatgatcggatcctgaacaggaaatccacgatcatttctactaatcttactctggaggaaatcaagacgaactatacagaacgtacattttcccggataagcaaccattataagatacttcgccttgccggtgatgatatccgcattcaaaagaaacttatgtacagggaggaacactgatgttacatcgaagtgaacgaattctggataatattccagttggctctctcggcattattgctgtagacggctgtgaagagatgggaaataaagtcaatgactatctcgtaaaatggagaaaggaagagactcgtttccagaaagacaatcttgttttcaacggctacgaaaagccgaactatctgatcaacgcaaaagtaccgcgttttggatctggtgaagccaaaggtattatcaatgagtctgtacgtggaaaagacctttatctgatggtcgatgtctgcaactacagcctgacttattcgctcagcggtaataccaaccatatgtcaccggacgaccatttccagaacctgaagcgtgtcatcgccgctgtaggaggaaaagcacgtcgtctaaacgtcattatgcctttcctgtatgaaagccgccagcacaagagaagcggccgtgaatcactggactgtgcacttggtctgcaggagcttgtccgcatgggtgttgacaatatcatcactttcgatgcacacgacccacgtgtccagaatgcgatcccgctgaacggatttgagacgatccgtccgacttaccagttcgtaaaaggacttttaaagcatgtaccggatcttcagatcgatgctgaccatatgatggcgatcagcccggatgaaggtgcaaccggacgtgcaatctactttgccaacgtactcggactcgacatgggtatgttctacaaacgccgtgactacacaaccatcgtagacggacgtaacccgatcgtagcacacgaattccttggttcttctgtagaaggcaaagatgtgatcatccttgatgatatgatttcttcaggtgacagtatcctcgatgtagcacgccagctcaagatgcgtaaagcaaaacgtatctacgctgctgcaaccttcggacttttcacaaacggtatggaaaaattcgaccaggcttacgaagaaggactgatcagcggaatcctcacaacaaacctgatctatcagacaccggaactgctcagccgtccttactacatcaactgcgacatgagcaaatacatcgcactggtgatcgatacactgaaccatgatgcttctatcagcagcatccttgatccaagcgaacgtatccagaatgtagttgagaaatataaaaaaggggaagcgatcgattaatttatacgagcgaaatttttccgctatatgacaaaaaatactgcttgaatatcattttctgatatctaagcagtatttttttactcttaaacgttaatttgtgaatactcggtaattctcttttttatcgtaatctttgcggatcccatcatcctcatacatggtataactgccgttctcatatccgataagctgcagatgtccggtatcaatatctttcacacactctgccgcttctgcaaccgggatacatttaccatttcgaatgaaaagcggtacttcatttgatgccacatctacataatggatacctttcgcgagaatctcttccgaaatgcttccatccggcaggaacttgacaaatttcatttcttccggcagataaacataacggcctcttgcgttctgctcgtaaaccggagcaatcatgatctcgtttccgagcatcagctgatcctctactcggattgctctcttgtcatccggataaacaaaccctaacggcttaaaatacatgtcatcactcagcgcagctttcatgtactcgctgtacagatacggcacaagacgatatctagtgttaatgacagcacggaaatcctcgatattttcgaattgataacactcctgctctcttgttcccgtcgccgaatgattacgcatcagtggtgtaaatacaccaagtgcgagaaaacgaagcagcaattctcttgttgtatcagcaccaaaacctccaaggtcagcacctgtatacaggaaaccacacatgttcagagacggcaacatcttcaggttaagaaggatatgtgaccaccaggatttattatctccggtccagattcctccataacgatgcattccgatgtaagaagatctggaaaacatcagaaaacgtttttccgggtcaatgcgttcaaacgcttctccggccgctcttgtcatattatagccaaaaagattatgtactttgtcatgacggatctttttgccttccacattgtgataaaatcttttatagtcttccgggttattcgcaatactgagcatcttgtcctgcatttcccaaggatggatcttgccttcggtatcctttgcaaactctccggcaagttctcttgcctctgcaaggccttcggaagaataaaagatcgcaggctcgttcatatcattccagaaaccttctattccctgttcgatcagaaaacgatatttgtccccgaaccattttctggcttccggattcagcatatccggaaaatgggtatctcccggccatacagctgcaacaaaatcacttccgtcttctctcttgcagaaatagttgtttttgacaccttcctcgtaaatctcatatcccggctcaaccttgacaccggcatcaataatcggaatcaggcgaatactctggtcattcatttcttgtacaaattccggaaaatccgggaaattctcttcactcactgtgaaatctttgaatgactgcatatagtcaatatccatataaatcatgtcgatcggaatatgattttcccgatatccttttgcgacagtacggaaatcttctttcgtcgtataaccccagcggctctgtccgaaaccaaaggcaaacttcggtgggatatagctgcgtccgattacgtggcggaactgttttacgatatcataagcattctcaccttcaagcacgtagatatccaagtcagcattttcgcaagataccttaagggtatcctctctgtcatatccaatatcaaaggtcagttttgatggatagtcgaaaaataatccaaacgtcctctttccgctcacaacaatgaagttgtgggctccgtacagagaacgcttgtcctctgtgtgtaccggatcatctgtacaattactgatataacagtaccctctcttgttgattccacgattggcttcacccagaccatagacaatgtcatcttcatccatgatataagtaaaaacaaatccttcctcctgactgacctctccatacgggagaacgcccttagttgtttcaatcttttcagtcagtgcctccgtatcaaacggagttccatatctatattttctaatcatttctttatcacctagtgtttataatatagtacaaatgcttcatatggattcagaacaatttttccttcaaattctttttttccaaggtttgtgatcagacactctgcgcctttaaattcttccggcacttctacttctgcattcttatcgctgaagttgcagacagtcagaagcttttcctgatcctgttttcttgtgtacgcaaaaatctgttcatcctcacggtaaagaggttcaaattcaccataaacaataatatctttttctttacgcaatcggatcagtttctgatagtagtggaaaacagaatccggatcttcaagctgctgtgctgcattgatcttcttgtagttcggattcactttgatccacggctcgccctctgtgaatccagcctgtttactgtcgtcccactgcatcggagttctcgcattgtcacggcttctcagcatcagacatttcatcatgtgttccggagtcataagacctgattccgtaaactcttcaaagtaattaatactttcaatatcacggtaatcttccagtttgtcaaagtaaatgtttgtcataccaagctcttcaccctgatatacatatggcgttccctgcatcatatgaatacaggtcgccagcatttttgcggaggtttctctgtataccggattgtcatttccaaaacggctgacacttctcggttgatcatgattacctaaaaacaaactgttccacgccttaccctgaagttcttcctgccatttgatcataatatttttgaactctttgaagtcatattttgcagtcgtccactttccataatctccgcatccactctccacatgctcgaattggaataccatgttcaattcatttctgtcatcacccgcatatttctgtgcttcttctattgtgactcctgcggtctcaccgactgtcatgatatcatattttgaaagaactttttgattcatttcctgaaggaattcgtggatccttggaccatgtacacaatatggtccaaagtccccataaagaccgttattcatttctccgtccggaaatctctgatctttggaaatcatactgataacatccattcggaagccatcgattcctttttcacaccagaatttcatcatgtcataaacttcctggcgtactttttcattttcccaattgagatccggttgtttttttgaaaacagatgcagataatacatctgagtttgcggatcatattcccatgcagaaccgccaaatactccgccccagttattaggttcttttccgtttaccgggtccttccagatataataatcacgatatggattatcttttgattttctgctttcaataaaccagttatgttcatctgaagtatggttgactacgagatccatcagaatcctgatggatcttttgtgtgcttcacacaacaattcctcgtaatcctccatcgttccatattcttcataaattctgcggtaatcagaaatatcgtaaccattatcgtcctgaggtgattccagcatcggagaaatccacaacacatttaccccaagttctttaaggtaatccagtttctgtatgattcctctgatatctcccacaccatcaccgttactgtctttaaaactctttggatatatctgatatactacactttctttccaccattttttctccatgccaaatctcctcgtttataattgtttagtattatttaaccgctcctgtaacaacactattcatgataccccatacatcttagcaaaatcaagaggtttctcgcgaaactataaaagacaacaaagtttatttcctgcttttatacagtctgcacaaaaacaaccagaccattccatcggcttacctgtatacatgcaaagtcgaaaaaaggatcctgtcattccctgacagaatccctctttaccagatagactggattttttatgtttaattcgtccagcgtctctccctgaattaacttcagcagacgtttcagcgccacatgcgccttttgcggaacatcctgatgaaccgttgtcagtttcggtcgaaccatacttgcatagacactgtcatcatatcctgtaactgaaatctgatccgggaccatgatgccttcatcaaaaaagaaatttatcgcttccatcgcattataatctgaggaaaacgcaagtgcctttgcttctaaaaaacgtgggagaagctctttgtattttctgagacgcaatcttttttcactcggaataattatatatcgggaacgactgcagaatccccccgatttttccatcgcctgtttgaatcccatccaccgatagtaatcactgtctctctccgtttccgcaacaaacaatgctttcttatatccacaggaatacaggtattctccgatctgataccctcccgaataatcatctataccgacattctggaaggtataagcaccttccggataagcatcgatcagaatcattttcttgtttaatctgcgcgaaagactgcgatactgttcttcattgtagccaaggataagcaatccctctacattccattttgaggcaatatccactacattctgaatactttcaccgccaataagcataacataatatccattttcttccgtttccatctgaatcgttccgatcagttctcccacaaatggatcctgaagtgactgcataccatgggcataagaaaatccgagtactacacctataattctggaaccatgaccggaaagcatcacggaacccatatgcggaacatagttctgttctttaagaatagtcgtgattttatcaatcgttttctgggaaactcttttggtattgccatttataacattagataccgtagtacggctgacgcctgccatttctgcaatatcctgaagccgaatcataaaatcttcctccttgtctttacaacatcaccttatgatatgcacatcccatcttttccagcatttccatctcccgcttctgacagctgaatataattacctgccgcttactgtctttcagccagcgaagggtctgcgcaagtctactgtcgtcataatagccgaatgcatcatccaggattaccggacattcttcctcgtggagaatttttgttgcggccatccggattgcaaaataaatctgttccagcgttccccggcttacttgatccatggatatctttttcccattactcataagttgcacatacagattttcatctacccagagtctgttatattttccatctgtgatggcatccatgattgcagatacttctgtattcataagatcgcttgtccggctctgcatctgtgcggcaagtctggtcagctgttccatagcaagttcaacaccctgcttgttttttaatcgctctatctcttcactgttcatctcatcgaactcgccgactcgttcctgcagattttcatacaacacttctttttcatgataggtttcctgtacttttgcaagctttcctttctgcctctcataatctgccttgagagaaatgccctgttcttttatctcctgtaatctggctttctttttcttctttccatctttcagacaattccagacatacagcccttcagccagtgccaccacgattgccacaagaaaattccacggcttatgaaaaagcagaaaagtcacaaaaaatgcccccagcatactcactgcctccagtggatgaatcctccacccagcaaaatatcctgctgcctcttcccgtttcttccgctttttatcttcatttacccagctttcccattctctgcgtttctcttcacagcttcttttcagttgttccgcttcattttctaactgatgcagatcccgccagacataggatgcctccatctctgcccgctctttcttttcgctgatcagctgcctcttttcacgttcttctttttccagctctttcttccgctcttttaaaagggcaagcgccccttcgagatcaatctcgctgttcccggttgcataataatttgccgcataattcttcagctccgccgccagtatttctccggtctgtacccggagctgtcctatcgaaactgtattttcatagtcactttctgtcataccacctaacagaatttccagatccccatgctcaagtgacaattcttctccatcatcttcacaaatcagagagccgcctttcgcataccgatcgaaattccgttccaggcgaaatctccggtcaccgcaggtaaaccgcaggattcccgcataaaagtttggattctcccaaggctcataggtacggaatgtatctgttgcggcagcacgtccgcgctttctttccattccaaaaagcattcccttcagaaaggtatgcagcgttgtttttcccgattcgttttctccgtaaataatattgatcccatccgtaagcaggatctgcttattcgtgaacttaccgaaattcttcaggatcagttccgttatcttcataatttgctcccctttgcctccagcatggcctgtactccctcagtcaatgcaattgcctccacactgtcatcctttgcttctgcaaaactttctatgtaccagcccagaagatttcctgcattttgttttttcaacttttcataatcatatgccggctttgtttcatccagaatttcgacaatatttccataggaatccatccggtcggtatcatagatcatatccggatcccgaaatccccgcagaatgattttataaatgttctgtatacctctttcccgtatggcaagggaaattttttctttcatttcccgtccggtcatctctcttcctgcttctacttccatatgcacatattctctggatgcaaaaggaataaattccgtccgggttcttccatttttaatctcccctttgatataaccatgcttcccggtgtcatttttatctgtaggctctagggatcctgcgtaatacatccggtcctctgcaagctctgccggaagatgaatgtgcccaagagcaatataatcatatcccagcttcagtaattcgttctttcggaacgggatatgcttttcatcgccgccatgggccagaaggatggatgcggattctcttttttccggaaggattttctcataaagcggttctgtgatttcccgttcctcatagctgagtccgtatatgcggaccccaagctctttaaattccatacaggcaggtttctgagacaaaaacatgtgcaccggtccctgccatttataattccggtaataggacgtacttttcaggtaatcatggttgcccgccatcagcacgacctgtgtatgtgtcagtctggaaaataaataatccagttccttcagctctcttaaaagcggctgtctgtgaaacagatcccctgcgatcagaagaagatctgtctgttcttcttcacagatatttaaaagacgttcaaagctattccacagttcttccggtcgctttgcggtgtaagaacttcctgcgtccggttctgcccccagatgaatgtccgctgtgtgtatgaatttcattactttctactcctcctttaaggggaagtgtcacgataaaacgtgtctttcccccactgctctcggcaatgatctgtcccttgtgcagctctacaatctcttttgcaatggcaagccccagtcctgctcctccggtactgctggatctcgacgcatccgcgcgataaaatttatcaaagatcctcttcaggctctcttcaggtatcatatctccttcattttcaaaacagattcttacctggttctcctccttggcagcctggattagaagtacacttttctcccggcagtatgctatggcatttcgcagaatattatcaaaaaccctggcaagcttatccggatctccctcgatcaggatctcttcctctgcttccaccttgcaggtcagcatcttctcctgaagtaccccatagagttcgtctgcaatctgttccagcatcatggtcagatcaatatccaccttatccagttcaatatcctgcagattcaactttatactttcaaaaaactctttcaaaagatcccccagtcgattcgccttctccagagatatctgcgtatatttggcgcgctcctctgccggcatctccggatgagaatccagcatactcagatacgccaccacagaagtaagcggtgtttttaaatcatgtgccagaaaaagcaggacatcatttttcctctgctcaagcttttctgcctcttcctcctggctccttaatgtctctttaatctcattgagacgatcctcgattggttttaactccgtaatcagccggattggctggtcagacgctgaaataatattttcaatcccatcttctacctgttccagataacgcgtcatttttgaaagtgccacataaaaaaacaacgaaaataaaagtaaaaaaccgaggatcataaagaacactttattattgccgatccactgccaatacaaagatgttgcggtctcttcactcacatgaaaagcttccaatattcgcataaagccattggcaaagctgtcattataaataccatcgataaaatactccagaataaatctgccaaccagcaccgtcagggccgtaataaaaaccgtctgaagcaatatgctcagttttaattttctgtaattattcttcaattttgtatcccactccccagacagtcttgataagatctgattttccagtcggtttactcaatttctcacgcagatgccggatatgtaccatcaccgtattgttgctgttcttcagatactcttcatgccagacctcttcaaataatctttgtgagctgatcacctttccgcgattctcacaaagaatccacagaatctcaaattccgtcggtgtcagcggaagagactgctcattatagatgcattcatgggattctttatttaacaagagtcctgcaaaatcaatgatattctcagaatcacttttcttaccatcgttgtactgcgtgtatctgcgcatctgtgctttcactctcgctaccagctccagcgggttgaatggtttcggaatatagtcgtcagcccccatcgtaagcccggtgatcttgtcccggtactccgtcttcgcggtcaacataatcaccggaaatgtgtatttctcacgtatctttctcagaatcgtgaaaccgtcaatatccggcagcatcacatccaggatcgccagatccacatttgtcttctcaatacattccaatgcttcctgccctgtgtaaaatttcaaaacatggtattcattttgcagatataattctacgacatccgcaatttctttttcatcatctacaactaaaatattcatatttcacttttcctttccgtatatagaaagatttgcgctataaaacagcagaccggaaaacacacccttttgatgcagttcccggtcccctttttcttcattcttcttttttacagttcgcagttattcacagttcttgggaacggaattacgtcacgaatgttggacattcctgtaagatacatgatgcatctctcaaatccaagtccgaatcctgcatgtcttgtagatccgtactttctcagatccagatagaatccgtaatcttcttccttaagtccaagctctttcattcttgcaacaagcttatcgtagtcgtcctctctctggcttcctccgatgatctcaccgattccaggaaccagacagtcaactgctgctacggtcttgttatcatcattcatcttcatgtaaaaagctttgatctccttcggataatcggtaacgaataccggacgtttgtagatctcttctgtcagataacgttcatgctctgtctgcagatctgctccccatgatactttgtattcaaatttgtcattgtgcttttcaaggatttcgattgcttctgtgtaagtaactcttgcgaaatcagaatttacaacgttgttcagacggtcgatcagtcctttgtctacgaaagaattgaagaaattcatctcttccggagcgttttccatcacgtagcggataacatatttcagcatgttttctgcaaggatcatgtcatcttccagatctgcaaatgcgatttccggctcgatcatccagaactcggcggcatgacgtgtggtgttggaattctccgcacggaatgtcggtccgaatgtgtaaatgttgcggaatgcctgtgcataagtttcaccgttcagctgtccgcttacagtaaggtttgtctcttttccaaagaaatctttggaataatcaacagttccgtctgcatttttcggcacattgttcatatccagtgttgttacctggaacatttctcctgcaccctcgcagtcacttcctgtgatcagcggtgtatgtacatatacgaatcctctttcctggaagaatttgtggattgcgtaagcagtcagtgagcgtactctgaacactgcctggaaagtattggttcttggacgaagatgtgcaatacttcttaaatattcaaagctgtgacgttttttctgaagcggataatccggtgcagaggtaccttctacaacaacttctgttgcctggatctcaaatggctgctttgcctgtggtgttgcgacaagtgttccttttacaatgattgccgcaccaacattcagcttggaaatctcgccaaagttctccatattatcatgatatactacctgaaggttttcaaagaaagatccatcatttacaacgataaatccaaatgtcttagaatcacggatactgcgcacccatcccccgatggtcacttctttatccagatattcctctctgtttctgtataattctcttactgttaccaaatccatctgttctgttcctccgtattactctcttatatatttcacataaccccaatgagccttgtaaacattgccgacagcttctgctgccattttctacttttgcaatatgtccagtataccattaaactaccgcagttgcaacgatgtaaaaagaatctgactacatttgaaagtactttcgcaatgttttttttattgtactctaatcaatattccttaatcgatagttcatttttccttaagaaattttctttttcttttatgatatagacatattttgaacacaatttatctgtatactaagagtcagatagttgataaacaactatctcccccctcataaagtaagcgcaatcgggttaccccgattgccgcactttactctcattcctttagataactataaaacaacgaagcccgttagcccttgtggttagcgggttttcgctgttctgtacttgttgcaaaatccgcttcggtcaaatctcggtcaaataattttctaaagaaatgttgcaccttttctattctctttcttattcttgttctgattatatgatttccttatacaaattctgtaatttatccatttccgattttgctttatcatctgtgacgtgcgtatacaaatccagtgtgattgctatggaataatgtccgaggaatccttgtactacctttgcgtcaatcccggcttcaaaacaacgcgttgcaaaagtatgacgaagtgcatgtggataaaaatgcggaatcggtataaacactgtcttgtttttctctgcctgcttttttcgttccttattgatagatttttctatccagtctaacgtcacttgaaaggtgtgttctgtaatcggttttccgttctttccaacaaacacaagattttcaaatccctctaatggttgccattcactagctgacaactgcatttctttcaactgaatccactgacgttttaaagccttatacacactgtcctgcatgggaatcgtccgtatactgttctttgtctttggtgtctggtacttgaatacatacttctttgtttccttatctttgatatacaccaacgttttatttacagaaatttcccgtttccgaaaatctacatcatcccatgtaagcccaagcagttctccgccacgcattcccgttccgagtgctacctgtatgagattctcgtgtattctctcctttgcgtgttccaatacttcccgttgttctttcacagtcagtacccgtatctgttttgtctttgttttgggaacttccactcctgcacatgggttgaatgtaagaatcctgttatgcactgcatatttgaacatagcattgagaatattatacacatcccgtatagtctttgtgctgtaatcatcatctgccatattctgaagcagacgttccaaaataatcggattaaaatctgccacacgttgttttcctatctgcttctttatgtaacgtctgtaaaaatcatcataacgtacttgtgtactctccttgatagtccgcttcttatgggtattcagccagatatcaaaccatgtatccagagtgatattatcgccctttcctttcaacccatgcttgacttcatagcgtaaatcttccatttcttgaactaacttttttaagtccgcattatcttttgtatacgtttctcctttgtaataaaaccgccctctgtaaattccgctttttctctgcataattcccggcggtaatggatttccttttaagtccttgcccaatctgcacgctcctttccgtgcaaggactatcagaactggtctgacagtattatatgcttatttgtgtttatactgcaattacttcatatttatttttcagattatgcccttcgtttttcttcaaaaactggtctaaaacctcagagcgtataagaatcttatttccaatccttatgaccggaatcttctgccatgtaatcagctttcgcagattatttcttccaattcccgtatactctgacgcttcattcactgtaagggctttctttgtctgtatcgttttctgtgtatgttctgtcaaagattctcctttcttcttccctcaaaaggaaagattttttatagtcctcatatatgcgttgttgttcttcgttcatctgcccccgttctattagctggcggatataatctctgttatccagttttccgattttatccattagctttaaagagggcgaaactgctacgttcagccactgccatgttcgttccagtgtctttttctctggattcatggtcaactttatcttccctacatcctgcatgagttcttcccacgggggataagtaggataaagccgttttcttgtaaccgtgctgttttccggcttctgtaaaaaccgcactttctcgtttaatacagacaacgcaatccgtgccacatccctgtctttcagaagttcttctactaatctgaccgcttttttgtgccggaatcgaagttcatatctgttccagtccgggttgagttcttttccgaacttttctgcctgttcatatcccttttcatagaatgtaatccgaaaatcactgtgtttactgccgagatatagtgtttttccctgcgcttctatttcatcctctttcagtctatcagaacgattctctgctgtatcacgcaactgactagatatcagcccctcgtttttcagacgaatcaattccgggatagacagataaggctttgtatcgtcgattgccaagtctatcctcggaaaattcaccgggtatctgcaaactctttccagaaaatcaaaccatgtttccttattcatcataaggaaattttcataattcctgcaccccgaaccactcataagaatctgaaatccctcatactgtgcatttcctgtcggtttcagaatcttgatattgtcaaatcttgctatcagttcgtgtccagcaattcctttttccttaccatgcagttccataaaactcagtggaatccgcaagatatcttctatgattatgaacacgtctacacctttgacagtaatctgacaccagtcaatcagtgctgtcaaatcttctttctgacgagttacccccctgttagtataggggggttctgaaattttcattacctctgttatcatcatccctgcctttcgtagtatgccgtggctttcgccacgttcccggaacttctctactccctttgctcctttcacgctgtacggagcagtccgcagagaatttccgggaacagtctctacacgtttccttttccggtaacaacacggatacccttgcaggagattctgtccaccaataccgggaagtttcctctctgcacataaggggcatataccgcttcttctagttctaccactgtgtaaggctctacctttggaagttctgttgcttccagacggatatctacgctgtttccaagtttcatgcttccgaggtgaagtttcaatgcttccacttcctcggttttcttccgggtttccttatcatacttgtagcagtagtctgctcccatgtaacggagttccccgaacgcttctctgacctgttcttttgtcaatgtaatctgcatgctacatttctccttttttgaaatcatggtgaatgagtgtctgtaagtgtgacaagtccttttcatatccacgtctatatttatttcattacttttctccttacctcttaacctcatcatagacctgttttttcttcttgtcaacaattattttactttttcccttactttttatttttgtatttcaaacgcttaactatatctttttataacttattataattttacccttacatttatccttatcttgtgttatgatgaaaacagaaacgaggtgtgcatatgtttgtgaataaagaagcagtaggaaaacgaattttacagatacgcaagaaatacggttacagtatgcagaagtttggggaaatcatagataatgccccgaaaggctctgtaaacagttgggaaaagggtgtgaatcttcccaatgagaaacgcttgaagcagattgccacgttgggcaatatgacgctgaatgaacttctgtatggttcatttaaagaatatgtagatatgcttatcacagaaaaactggggattgaactgccggaagaatttaccagaactttctattctcttttagagcagaacggatttacctacggggatgatatcgagattgtccggcttgtaaacggctttctgacttatcataaccttacaacaaaagaaaccgccattttctatcagccaactgcatactccggcgattattttgacggtatcatacaaaaagcggattcttccgttctggtctgccgggcatatgcagataaggcaaacaacaccttacatatcattccggcttttgagaatggacagactgaggaagtagcagacttctttcatgcactgaaaagcataaccgctccacacaacaacaattatttcacttccggctttctgacactcggactggcattgagagattccaaagtaattatctatggaattgatgaaaaacagggaacagcacaggtaatcccttacgaatatgattgcgaatcagacgcttatatccagaatgaacatctgtcatataccagacaggatagctttttccgagaagccacgaaagaagcggtctattggaaaatgcaatccgacagaagtaacccataagataaacaagaggacttgcaaggtttgtgacctttcaagtcctcttatgtatcatgatggtattggctgtgtccgttccgtaaaggactgccctacggcgtctcggcttcgccttgttcctttacctcactaataataatgttctgatagcagaactcttacttatacttttatcttactattctttcaatttttaccgtttcaccatcaatattatacttaaaaaaataaaatttaataacatttccttctgatacttgttctagatcacctttacacttagtacaatctaaactaacttttgtcgtatcaaaaaatagactactttcttccttctcatttagttctattaaaagtgtatcaaaagttttctctacaacaaccccactcaaatgaaaccaatgagaattatcatctccactagaacgcaactccatattttgacgattctccttaaaaacatttccttttacgccaagcacaattaatactattgcaagcaaaagtatgattaacaaaatcaatcgtttcttatccattaaatgtagtccccgatatgtctgtccaactatcaaaatcaaaattcaaataacgtactgtatccccccatccatcaaataccatcaatgtatgtactgtatttccagaattatatgctcgcaaagttgcatatccctctgctgccattgaatgccccgcacgttctccagtatcactgctaattataccacaatggacaactgctatatctcctctatcaatgcaattagtgaaaaaattataattgggactatagtcagtattttgtgttacagaaacattctttccagcacaaaagtccacaaatccaggtccaatattgccaatagttgttgaaccatatgttattcctccactctccgatgaaactgtcgttcctgttgaatcccaaatatccatataatcacctgcaatatctgtataatcaacagcattataatatgcaccacatgctaataatgcactaactgcacatgcataatgtcctgttacactttctatatacggctcattaaaggaaataaattcttgaagatgatttgttgaaacaagcgtgtagttttcataaacttcatcaatatctagcaaaacctcatcccaagtagctgggtcttttcccctactctcattcaaggacagtactgttttttctaatgtttcaccataattcgttctaatctttcccaaattatcaacaataccatattcaaacggagctattttatatatttcagaggtatttgctttttcactaaatacatttgcttcactttgataaatcacctcatatggatttgctgaattattaccaaatgagtattctgatatcaaagattcacacgtagtatcaaaaactacatatccatatggtttgttttctaaattgtaatttacaatatatccaatagcttgacctgttgtatcataaaattttctcggattattagcaacaatattgctattttctcctattccctttgcaaaacgttctgccatctgtatcgccaaatcatccgtaacatttacaacagaagtattctccgatgcatggacaggaactattgacataatagtcaatataaagattgtcaaaagtgaagcaaatcgtttaaaaatttttctcataaatatccttcctccttagattatatatttactttaatattatatcttattccctattttgtctatattttttttatgtttatttcaaatatttcattctattttatttttatcaaactattttcaaacaaatccaaacaaagaatctcggggcaaatttcggtcaaatcaggataaataaatataacactttatatgtaagtcaattttaaaaaagcctgtaattccgggctttacaacactttgtaacacaatataaaccagttcgataatccctcattcctttagaaattaaataaaagcacaagaaaacccgctggtcgaaagatcagcgggttttctcgttactgtttatgaaacacaaaatatcagggagctgcaaaacagctccctaaatcacatacgattattcttctacatcctgcacatcataatacttgatcagcgcctgtgtcccaagatctccgagcccttcctgtgccaactcttcataatttgacagtaccagactcagcacctcaagactcagtccgctcatatttgcctcagtcagcgcaagcttcatatccttgatgaaatgcttcataaagaatcccggtgcataatctccggcaatgatctttggtccgaaagcatccaactgtttgcttcctgctgccccggtagagaccgaatcaaaaaggacattcagatccagtcctttggcctgcgcataggaaaaggcctcacatacaccacttaaggccccggcgatcataatctgattagcaagctttgcatgctgtccacatccggcttttccctgataattgatgtttgttcccattgctttgaaaagctccatacaagcttcataatcttctttctcgccgccgacaaggatggataatgtagcgttttttgctccggtatccccacctgttacaggcgcatccaacacatggaatcctttttctgtgccctcttttgaaatcttttctgcaagcatcgggcttgtagttgtcatatcgatcagataggttcccggatctgcattttccagaataccgccttcatcgaagtaaacctcttccacatctctcggaaaaccaacaatggtgatcactgcatcacatccgggtacacattctttgatagattcatggaaaattgcaccctcgctgatcacatcatcgactttcgcttttgtgcttgcgtaaatatgcagttcatatcctgttttcataaggttgcgcaccatggattttcccatgatgccaacaccgataaatccaatttttttcatagtgaactcctctactttggacttacaatctttcctgccaccgcgcagcttgccgctgttctcggagatgccagataaatctcgaccttagaagttcccatacgtccaaggaagttacggttgttggttgcaaccacacgttctccgtctgacagaattcctccggtacgtccacagcaaagtccgcaacccggatgggtaatgatcgcacctgcctcagataaagtcgtaaggattcccatatctgctgcctgtttgtagatcttacggctcgccggagtcacgatcagttttacaaaatccgcaacttttttgccctttaacacttctgctgctgcctgaagatcctccagacgtccgtttgtgcaagagccgataaatacctgatcgatctcggttccttctacctcggatacatttctgattttgtcaacctgtgacggaagggccataaccggtacaaagtcctctgctttataagtgatcgttctcatataagttgcatccggatcaccaaccagactcttctgataatcatttaattcaatattgcaatactcggcagttttctcatccggtgtgaaaagtgcgcattttgcacctgcttcgattgccatgtttgccattgtcatacgacttgcaactgtcatattttcaatggtgcttccggcaaattcaagtgctctgtaagtagcaccgtctgctctcaaatcaccgatcagtcgtaagatgatatcctttgacataacattttccggaagttcaccatcgatcacaactttgatcgtctccggtaccttgatccacatcgttccggttccaaggatacttgccatctcggtataaccgataccggatgagaatgctccaacacatccataagttgtggtatggctgtcggttccgaatgcgatatctcccggtttaacataacctgcttctgtcataagctgatggcagattccgtcacttctgtgtacatgtgtaagtccgtatttatctgcaaatgcatctccggtacgaaaatgtctggtatcatcctgctgacttgccggaaccagatgatcatagatcagaacaaccttgtccggatcatgcagtttcgtaaatcccatttcttcaaatttttctgccacaaaggggatgaaaatatcatggatcatcacgcggtcaacgttaaccgtcacaatgtctcccggctttacagcttttcctatattgtgtctgataattttttcaataatcgtctcgcccattttcttctcctttccggttaatccagtccattcagcttgcgcatggcttttaccagaccgccagcctgaataatgctcatcagattctccggcagagaagcaatcggatattccttaccattataatccacatgctcattcatcactaccgtgatctcgtcgccctctttcatatcatcataaagatccggctgttcaatcagaagaagtccgttgttgatcgaattacggaaaaagatccttgcaaatgatttggcgatcacacactgcacacccattgccttgatgatctccggtgcctgttctcttgacgaaccgcaaccaaagttctttcctgctacaatgatatcccccttctggatctgtccggcaagttccggacgaagaggagaaaagccatactgcttcatatcatcgattgtcttgagtgcaaggtattcagttggaatgatgatatcggtatcaatgtcatctccaagaacccatacacgtcctgtaaatttatccatcttatgtcacctcgtcaaacgtaatttcgtctcttacacatcacttgccagtgcaatttctccggcaatggcagatgctgtaacggttgcagccgatccaagatataccttggaactcggatgtcctgcacgtcccttaaagttgcgggttcctgtactgatcaggacttcattttcaccgattacgccctggcagcttccccagcatacactacagttcgggttcatcacgatcgcacctgcatccatgaagatgtcgatcagtccttcttccagagcctgtctgtaaatagtctgacttgccggaacaacaaggaatcttactttttcagatactttctttcctttgataacctgtgcgcctacacggagatcttcgatacgtccgttgttgcaggatccaaggaatgcctcatcaatcttgataccgcgcacgtcttttgccggcgcaagattgtctacaaaatccggttttgcaacaaccggctctaccttggataagtcaaatgtatattctcttacataatgcgcatccggatcgctgtgatatacagcctttggctcgcgtccatgctcttttaaatattccattgccacatcatcaacttcaaaaataccggtcttagctccggcttctactgccatattgcaaagtgcgatacggtcactgattgtcagagtcttcgcgccctctccggtaaattccatcacctgatagttacatccgttggccccgacttcaccgatgatggtaaggatcagatctctcgcatatacaccttccggcagctttccaaccaggttgaatttcacagtctccggtaccattacccaggaagttcctgttaccataccgtaaaggaagtctgtacatccaacaccggttccgaatgcaccaagtgcaccgtaagaacaggtatggctgtctgcaccaaagatcagttctcccggacggacataattttccatcataatctggtggcatacacctttcccttcccagaaatcaatgtggtttgcctttgcaaaatcacgcatcttcttctgggatgcggctgtctttggacagtcagacggtacgttatgatctacgataaataccagcttgcctgtatctgcaatatgtggattttttaatttattattatacatatcaacggtaagatgtgtagttccgtcattactcatcagacgatccagttctactgtatggatgtcacccggctttacgctttccacaccggctgccgctgcaatgatcttttcagcaattgtcattcccatcgtctattcctcctcacggttcagagacgcaataagtccgccctgattcaaaatattctgcatatattccggcagttttgtgcaggaataaacctttccatttgcctcagcggttccttccagcatatgaagctccatctgctctccggtctttacttcatccggaaggtctttacagacaatagcaggaagtccgatattgatagcatttctataaaaaattcttgcaaatgattttgcgataacagcttttacacctaacgcttttaacacacccggagcctgctctctggaagatccacatccaaagttctctcctccgaccacgaaatctcccggttttaccttctgtgcaaaatccggatccagagattcaaatgcgtggctcttcatctcctcaagattcggcagcaacagatactgggatgcaatgatctggtctgtatccagatcgttatgaaatttaaaaatagtccctttttccataaagcatattcctttctgtatacacatgattcctttattttaaggcttttccggcatttccgcaagggaatattttaacaggctaacgttgtactttattcaattcctatttttcataggttcccttgcaaatgattttttctttttgcatgaagatttttccacctgcaatataactgtcaagcttcaggtcattgtcccacaaaagcagatctgcatcggctcctttttgtattgtccctttcttaccctgcaatcccagtgcctccgctacatgtgatgtcatatatggaagtgcatcttccagcttcatatcaagctcatgtaccatatacagaagttcttcccgcagcgcatctactgaggaaacaccgatttccaacaggcttccgtcttctctgtattttgaccagcttccgtgtccgtcggagctgatggtaatatgctccgtcgggattcccttttcttttgcttctaaaatgcatccgcccggacaaaagtcctcactgatgccacaggtgagatcgatgtatccacccttttcaagcaactgatagccctcttccagaagaccttttctgcggttcacatgagtcggacggaaaatcttgatcggaatcatactcttttccaaagcttcaaacaccggcgacaatccagcatctgcatctcccatatgcagcaccacgattccaggttttccgcttaacatacctgccgttctggtcttgctcgcaagctggatcagttcgctttccgtcacattcggtgcccgatgatctgaaatggcaagtttcacgccaagtactttttcaacaaacataatatcccgatctacctctccggtaatagtcggacttggatatccatatgcaccggtaagcatatacgcacttaccccttcttcgcataaagcctgtacttttgcgtaaagattttcaacactccttgtaagtccgtccgttccaagaagtcctacaaccgttgtaattccgccttttaccagttctgacagctgaagttccggtgtacgggtatgaaagcttccttccccaccgcctccggtaacatgaacatgctgatcaataaaccccggtgtaagaattctttcctctgcatcaataacttcacatgcgatcggaaaatcctcgatcttatcttccatacattcaatttttcccccacatactaaaagatccttttttccaacatactccggtgcataaacttttgcatttttaataagtaacattttctttcctcctctttatgacattcttttattttcatacattaatttgtctgcctgatgaattgcctccgcaatcggatgtccccatgtgtatctactatctcccttccctcttaattttatctttctatattatcctgcttcttcagcaattccaaaagctctttttcaggaagcggcttggaaaaataatagccctggatcatctcgactccccagctgctgatcttttccatttcttcctgtgtttccaccccttcggaaacaatatgataattcattttatgaaatgtttctacaacactttcatagaaaattgcccgtttctcatccctgcagatatcaaaaagcagagatctgtcaaccttgatcacagaaaacggaagcctcattaccgtattcagattcgcatatccggaaccaaaatcatccagacaaaaaccaatgccagcggccgtaaattcctccgcaactcttcttagacccgcattgcattcagtcgcaaccgtttctgtgatttcaaactgtatccagttatgtggaatcttataagcatccataatccggataaaatgtctgctacagtcatttctcatcagatccagagaagacaggttcacttttacattcagaagatgcctcatcaggtatcggttttctcctaaaaatctgcagacacgactaaactgtagatctgtgatctgttcgatcatatgatttttttctgcaatctgaataaatacatctggtgcgatccagccaagctccggatgctgaaggcgacttagtgcttccagtgtgataaagcattttttccgtgtagagtaaaccggctgatagtatatctcgaacagatcctctgtaatcgccttatgcaaatactgttctactcgtttattataaaggaaaccattcatcgtctgataatcatcctgtatcacctctgtcagaccatttttcgcagataaggcttccagatattcagcatactctagaataagcccgctgtctccaagtttctgcgcattcatgatcccgcttatgatcacaggcactgtaataattttattgttgacattcagcttactgtttccatcaaacattctcttcagctgcgtaagataatattcatattcttcaagtgaaccggtaagtatcataaaacgctttcccgttgtacgaaatgcttttttcccgcacatctcaccaagttttcttgctgtcagctttaagattaaattaccgccctgtacccctgcgattttattaatgtgcctcaattgataaagatacaccgtaataatgtgaaatgattttgccgcactgatcagctcattgctttttctgaccagatacagatgattgtataatccggtaagtgtatcgatatttgcatgaggattgttgatcgtaataaatagtgccagaattcccagactcataccaaaccctgttgtaagaagcggatgatataaaagctggatcaccactcccgcaccggatatcaacaggatttccagcaggaccttcacttttcgatagcccagttttttccgccatatgacaataaggatcaaggctgctgccatatgacaaagtgcactgtaatacatcagcatataccatggacctttcatatagcctgccggtatatcaaaataaaacagcttttctgtgaacgggtttgtcagaatcatccccatcagaatgaatgtcggcacacctgataaaaacatcttttttgccgaaatgatcttattatcatataatgtctgaatataacagatcaccgtaaacggcagcaatgcctgaagcagataaaagatcgttgttgcaagcattgcagcaatttcacaattactatttggaaaagaaatataataattactggcaagttccgcaaccacatctaaaataccgatgacggcaaagaaaaggaatacctgattattcagatcctctgctcttttctgtcccagaaaataccataaaaccagcaacaatataaccattgccgcaataagaaaatctatattataagtcatatttatcctccgccggtttttatttatttgaacaaagcatatcgtctgcctgctgttccagaacactcctttctgcactctggatgcttcttgccgttcggataaccgtttcatcacccatctgtcttccagatatatcattaatcttcttcagttctgcaattttcacaaacaacaataatacattttcaagtaaaatcgcaccctcctggatctcttcaatatacatctcaaatgatttccggtttttcatatctgtcatccggtcttccaaggacattctcctataaacctcctgttccaggcaaaactgaatgttgttggatactttacaaagcaatccccaaaacaaaacagcaatataaagaagaatgccaaactggaaaatagattcataccagtaaatggataatacccagtacagtaccagtgcaattacaccgcttatccctaatacaccaaatgcctttagacagagatttacttccttctcctgcgttttccgatactctttccacaaaagaagaatcatagacacaacccccgtaaataataaaagatgtgtgataaataacatgtctataaaaggaatcctaaacagaaaatacaagaatccctgtaaaacagcatttgcataaagaagaaaaatccagacctgcggtatccatcttacactttcactcactgtattttgtacaaataacagcatgggaacaggcatcgtcataaacgcataaaaggatatcagtgttcctgctgcgttctgacttccatacatctgataaatccctgaatcaaaaatgcaccacagactgcatagaatcaaaaacagtgctacatttaaaaatctcttttctacaatttgtctgtgtctggtatataaaaagacaatcaccgagaccagtcattcccaaaatcatcagtatcgaaaaaaatgatcctagaagatgctgcctaaaaataaaacaaaactctccgatcatcggggcatacacatatagtctggcattctttttagtttcatagctgattgataacacttcctgcccgattttctccggcaaagaaatatctgcccatattttccctttcatctgcctgtttttttcaaatctgttatccttatattggtagagaagccggtctcctatgcagacttccagctgatcctgtattcctcggatcgacaagatttttcccttatcagcctctgataacatatcattgtaaagaatgatctgcccatctttatccgctgtaacaaaacacggcaatttgagcttcgtctttttcccatccttcagctgataccatccattgctgaaactcgcccctttccgactccgtacccggctgatacagtattctgacaaaaataagcatcaatgtcacaatgagcaaaatgcagaatacttcaatttttttccatttctttccttttttcatttccctcatctcctatgcattctgccggaagcttttctacatagaaaatgtaatttcctatgaaacaaaaaagtcacctgcgttatacaggtgactaaaatttaagccgaataactttttttcacttactctattaacctatccgcatcttcttattgcaaccggctgacatagcgtactgccttagtccctttggctttgcgtcacagtttttcaacagctttgcccctataaacataattccagtatagcatattcaagatgacgaaacaatattttaattgttataataatctatagttttacacataatccataacaagaaacatcggatactttctgatatattcttccatctgctcaatggctcccgaaagctgattttcaatatattttctgttattttttgatgtaggaagcacattcttcacataccgcatttttatatatggtatattatatttgtataccaaaaaatctggaaacaattgtttccagatttctcctagaggcgccaaccagatttgaactggtgatagaggtgttgcagacctttgccttaccacttggctatggcgccagatgactccgacgggaatcgaacccgtgttaccgccgtgaaagggcgatgtcttaaccgcttgaccacggagccagatattgattttttcaaaattaaaatctgcaagtaattggctgacagattttagaactccccgagttgggttcgaaccaacgacccttcggttaacagccgaatgctctaccgctgagctatcgaggactacttttattattataaacactttacatgcattttgcaagtgcttttttcattttttatgtactctgaaaaccacatacaaatttaaatctttactccatccattctttaccctgtcctaccttcttggttatgccctcgaccgattagtaacagtcagctccatgcattactgcacttccaccgccctcttcctgcttctcggcaatatccgtcacataatatccactctgcggtctggacacaatataaccttctgctgccagaagcatatacgcattctccatcgtcgtccggctcatctgcagctcgcttgcacctttacggatcgatggaagctttgtctctgacttcatctgcccggatagaatcagattcctgtaataatgatacactctcagataccggcagtgttcctcattctgtaattctactctcataactgacctctaaaaaatatttctttttgtatattttacaaatgacacttttattttattctatataaaacacataagaaatgcaagaatttttcattttgtatttcggaaaggatacttcaatgataaaacgagtcgctgttatcaatgatctgtccggtcttggtaaatgctctctgacagctgcgatcccggttctttccgtcatgggtgtgcaggcctgtcctctgccaacggcagttttaaccaatcagaccggctacgacagctattactgtacggactttaccgacaagatcgatcattacacagaagaatggcaaaaacgtggtcttaccctggatgcgatcagtaccggatatctcggcagcgcagatcaggcggaaaaaatcctgaatttctgtgagaagttcagaaccccttccactctgctctttgtcgatccggtcatgggagattccggtgtcaaatatgacattttcactcccagactccaacagcagatgcagaagcttgtatcccatgccgatgtgatcacgccaaatcttaccgagctgtgtcttttaacacactctgattttgcagggcttaccaagtataaggacgaaccggattatctggaccggattgcccggattgccgctccgttgaaagaaacgcagatccagacgatcatcgtcaccggtattctttatcaggctccttctgatgataccgtaaaatattacaatctggttctcgagaacgaccagataagcgtcatttcctctggaattcacggaggaagctattctggcaccggtgacctgctctccgctgtcgtatgtgcctcgatggtacagggaaaaagtgcagctgcaggcgtggaaaaagcatgccggtttatcgaaaaatctctgattgacaccgttgccgaccagattccgcgcaatgatggaatcaattttgaatcccatctttctatgctgcttgactgacatttacaaaataaataaaacctagggaggtaactatcatgtcatctacaatcattaacaatccagaaccatctgcaaatgcactttctcatcagaaagtctccagactgacttcaacagctctttttgcagcactgatctgtgtgacaactgcttatattttccatattccatttggtgtaaatggcggatatgtacacatcggagattctctgatctatcttgccgctgcattcctcccaacaccatatgccatgtttgctggtgcaatcggtggtgccatggcagatatcctgactgccccggtatatgcacctgcaaccttcatcatcaagatgctgatctcccttccgatcacatgtaaaaaggacaagatcgtgaatgtacacaactgtgtcggcgttattgttgccgctgtaatttcctttattggatattatatcacagatgtaatcctgttcggaacctggggtgcactgattccttcgattgtaggaacccttgcccagtcaggcggaagtgctgtgatctttatcattcttggttccactcttgacaaagccggtttcaagaatacaatgaaaaacaaatttggaatttagccaaatatttaatcatacgcaaatgacaggtggttcttgaatatccgcctgactttcaaagaggagattttattataatgtcagatattatttacacatttaaaaacaatgcatattttaacatcaccaaccgctgcacttgcaaatgtattttctgcatccgtaacgagcatgaagccatcggagaggcaacagaactttggcacgaccacaatccttctttcgaagagatcaaggcagctattgatgcttttgattttacaaattatccggaagccgtcttctgcggctacggggaaccgacctgtgcctacgataatctgattgctgctgcaaaatacatgaaagaaaaacatccggaagttctccttcgcgtcaataccaacggacttggcgaactcttcaataaaaagccaatcgcagaagaaatggcaaaatatatcgatgccgtatcgatcagcctgaatgcgccaactgcagagcgttaccaggaagttacacagccttgttttgaaaatgcattcccggatatgcttgctttcgctgaaaaatccaaaaagttattctcttctgtccagttcagtgtggtcagcatcatttcacaggaagaaatcgatgcgtcccagaaactcgcagacgagatggggattccgttgaaagttcgaatttattcgtaagttcattctcttttctactataattaacaaagggacggctgccatactttgcgctgtgctggcagaaggaccaaaagaaaccggactaattccattatgcaaaccattccgatgagcctcttaaggcgaaaatcgtgttcagcaaaggcttccacgatttttgagtctcatctccattgcataataagtgaattaatccggtttcttttggtccttctgcccttctagtgtattcccgtcagcctgatttttgaatgcttgtagcaaagcgaatgaacagaaacttattcattccggttgttattctccctttcaactctggttcgatgtttaacgaaaataatacatgttttccaataaatgcccgatagtcaaatgttttcaattaaacaacagactcctcatcccttctcaaagttttctcctgcttcgttctgaattgctgttatcttaccaatatcaccacattttattcgataaagttcaaagaacgccagccacaaaaggaatcgttcggattctattttgcgctatggagatgagactcaggaagcatggaagcctttgctgaacatgtttcccgtcctaagaggctcatcggaatggttagcgcaacttgaatccgaacgattccttttgtggctggtgctcactcaacctctatcattcgccaaacaaaaatgaccatatactttcgtatacagccattctgtattctctcaaagagaaaactttcacatttttatccaaaaatccctccgatcacaacgtaagacaggatatacatgatcaccgatgccatgcatacgccgactacgattgctccgaaagcttttttccagtcgatgccaaggagggatgcgacaagagctccggtccaggctccggttcccggaagcggaattcctacgaagagtaccagcccccagaattcatatctgctgatccgatcacttttgctcatcgcttttttctccagcttttctacaagcggacggaaaaggcgcgtcttgcgcagccatgcaaaaatcggacggatcagaagcaggataaacggaattgggatcaggttcccgaccagacagatcgggattgcacgccaggtcgggatatttaaaaacgccggacctgccgcaaggattcctcccctgagctccagaatcggaatcattgaaataataaagataatcagttctttggcagccttgccacccaaatgagttacaaaccactgtactaaagtttcagtcatacaaatctcctatttttttacttattaaatcggtgttcgacgtgtcaatacgcataaattgcttatttgtgtaagcacaaacgcaatttatgtttttaacacttacatcatatattcacggaggaaggcaaagagtgcttccatctcttctctcgtaccgatcgtcacacgcagatattgctcaatccgcttgcttccccagaaacgcacatagattccttttgctttcattgcttcaaagagttcttttgcatcgtattccggatgtgatacaaagatgaagtttgcgcttggttttggaaatacaaagccgagctttttgaattcttcttctgcccagtctcttgtctccacaattttacgtgttgtctcagcaaaatattctttatcttttaccgcttctgctccgtataccagagaagttttgttcatagtataagaattgaacgaatattttgcatcgtttaaatacttgatcaggagcggacttgcgattgcatatccaatacgcattccagccatcgatcttgcctttgaaaatgtctgcgtaatgatcaggttgtcatatttgtccagaagcgaaagtgctgactctcctgcgaaatcaatatatgcctcatccacaatcacaataacatcctggttgtgtctgatgatatcttccacaaattccagatcttcatagatggatgtcggtgcatttggattcgggaagatcacaccaccattttccggataataatcttcttttatgatatggaagttttcatctaccttcttgcattcgtatggaatccggtaaagatctgcccatactttgtagaaggaatatgtaatatccggaaagaaaaccggtttttccgagttaaagaaggtaaggaaacacatagagagaacatcgtcagatcccactcccacaaaaacctgatcttttccaacatgataaaagtccgccagtgcactgaccagtgcatcagatgtcggatccggatacagccttaaactttccacatgaccctccagctttttcatcgccgcaagaactcccggtgcaggtgggtacggattctcattggtattcagtttgatcacttttttctgtggctgttcacccggaacataaggttctacttttcggatatttttctcaaattctctcatcttgctttctcacctttctgtcacatcttttgcttttgtcttatcctagctgatattcttttgcaagctctttgaatttcggcagtgcatttacgattgtctcataagctacacaatatgcaattctgacatatcctgcacatccaaaagaacttcccggtactagaagcagattatatttttttgcttcctggcaaaatgtcttttcatccttgatcggagtcttcatgaacaggtaaaatgcaccctgcggtttgacacattcaaatccacattctatgagtccctggtaaagagtctccctgtttctgttatagtatgaaatatcggttttctcatgcaaacatcttgcaactaccttctgctgcagggttggcgcattgacaaatccaagaatacggtttgcaacatttgctgctgcaatgagtgtctctgaatcttttacatcatccggaatcaccagatatccgattcgctctcccggcagggaaagagatttactataagaatatcctacgatcgtattggcataatacctggtcagatacggtacatccacaccatcataagcaagctcacggtatggctcatcagagataagataaatctctgttccgtattcgttctgcttcttctccatgatctctgccattttcctgatcgtctcttcggaatagacaacaccggtcggattattcggtgtattaacgatcactgcttttgtcttcggtgtgatctttgcctcaaattcatccagctttggctgaaaatctacggtattcggtgagatttcaaccagaacaccgtcaaaattattgacataacttctgtactctccaaagtacggtgcaaatgtgatcacttcatctcccggatttaacagtgcttttaaaataacatttagtccgcctgctgcgccaactgtcatcgtaatattttttgctgcaaatgcagtaccaaaccgctcattcagagattcagctacagcctggcgaacatcttcatatcccgcattgctgttagtatatccatgaagcaccagttcatcttcttcatccaaaatatcaagaatcgcctgctttacggctttcggtgccggtacatttggattaccgagactgaaatcaaatacattttccggtccgtaaatttttgcaagacgatttccctcttcaaacatggcgcggatcgccgagctgtttgccaccatattttccatcttcttagatatcatcttttgcacactccttttcgctgtcttcgtttaatgtcacaacacctttttctaccataaataccggtttgtaggaaagcttggcctttcttaatccttcttctccaacatcatcttcccggttggtatatttgtattttccggcaacttcatgctctacgaactgctggttgatcatggtatacgcaccttcaatatccgcataagctttttcgatatgaaccacaaaggtatcgtcatttaccgcttctccaatcgtaaatgcaacaatctcatcaccaactctgagcagacctccgatcaggttcagttctttgtaaaggcgcagtgaattgagtgttacacacatctcggaattcttctcttcatcatcttcacagccattcagattccgccatttcagtgccatctgaaaacactcttccagattatcctctgtaatcgtttcgtaactccagttatctccgtgaagtgctttaaatttattgacgtgattcctcttgccgtgcagctttttgccggaaagtgttgcaagtttctcactttcatagacataatccgcctcatctctgtgataggtgatgtcgaatttgcctggaaaccatgtttcaagcttggcgaaattctcttttgtcaccccatacagacagaatggaacgcctttttctttctcccacttcatgatatcttcaatcgctgcttttacatcttcatcttcacctgccggaaatgcatagccgtaacctgcactgttgtcccggaacaggagaacgttattatattgtgcaaattctacttcgtaaaaccttgcccacagatatacatttgcaaaagtacggtcgcagcttctgcttgggtactttttgaaataaaaatcaataagatcccggtctgtcagttctggtcttttaaattttgcttctgccataaaaaatccttccatattccgcttttttgcggtactgtctgttagtataccacattttgagttgatttttgcggttttcttgtatttttttgtgttacttgtaaagttagtgagccaagactgcaaaatagaacgttccaattccactcggcaaaccattccgataagcctctgaaagcgaaaattgtgtcagcaatggcttccacaatttttgagtcttatcttcattgcctcgaatggaattggaacgttctattttgcagtcttggcagatctactttactggttatgactgttgccccagtacgaggtttttgccaaacaggaaaccgcaaaaacggctttatttgttcgtttgttccggtatgattttcttcgacagacataaaaaacgcaaaacggctttgttgatccagttgctccactactgttttctgaaataaaaactatttcagtctatagatgaatacaggaagtggaggatcatttttacggttaaaataggaatttacgattacgagccattttttggagtctaatgttttgagataattcaaaatggcttctttttcttcgtagccggtgtcgccgccgctgtagatgcagaggtttatgatgccaccttttttgagcaggttaagggctgactcgatggcggtgaggctggtggctgcgcgggttgcgattttgtggtcgccgccggggaggtagccgaaattgaagatgatgaccttggcttcttcttttacatagatctgcattttttcgtgaccgtcctggatcagcttggctcttgtcgacaggttcgctttttcgaggcgttctctggtgtgagcaatcgccatctcttgcacatcaaaagcatagacatttccggtctctccgactttctggcacaaaaactccgtgtcaccgccgtttccggcggtggcatcaatgcagatatccccttcttctatatactcttctaaaatgtgatggcaatattctgtgatctgaaaattcatgtcctaaacctcctgcttatgttcggaaagtgcgcattgcctcgatgctctgtgcgatcaaagcttccttcttttgttatcattttctgtcacttatctgtcttttatttaccgggcaatccatttggaattttctggcgaataaaaattaagcatttcccgtacttctttttcgttatcgaatgggtttctgataatcttatactctttaccttcccatgggatggtgatcttaccatttttcaccgtcatctgctcgatggctgtccgtggcagctgtacgagttcattgccatccttgtcatagaatgccataccattgtcccagtaaatgatcacacgcatcattttcattccatagctgcgcgtaaccaggcacaccactgcgatcacaaggaaccagatactgtaggtcagcccgccggcaatcccgcttcctattgcgcacagaatgcagaaaactgcaaatggaagcatcagatatttaacggtcatgccgctgtaatacccggataccagacaatgaaaactgcccttccattcatttccaaatttcgcagcttcctgctgtgtcttcttctggatcacctgattcaccgcctgcatgatggcattccgaaccaggcgctgtacaatatgtcccatcttttgtacctcctcatgttctctcatttatgtcaattttagcatatcctgttactttttcaatcacgcagcgttatatatgatataagtttttcttatatcactattcatagaatgtatttcccatttcctcccatttctcctaaattagaagtatcgacttatggaggtactgaccaatgaaacttactacaaaaagaaaagaacagatttcttctgttctcatcatctgcctgggaaatatactcaacgctttttcagccagagtctttcttcttccggctgaccttgttgccggtggcacgaccggaatcgggctgatcctgcagcgcataaccgggatccctctttcctctctggtgctcgctttcaacattatcatgctagtgcttgcctatattttcctcgggaaaaaatatacattatctgcaattttaagctcttttatgtatccgatcgcactggaattcttcaatcagatccttggagattatgttctgacagacaatctgatcctatgcacactctttgctggcatcggaatcggaatctcccttggaatgatcatccgtaccggtgcttctaccggtggcgtagacgttccgccactgatcttaaataaatatttccgttttcctgtttcagccggattgtacatcattgacttctttgtcatcctggggcaggcactttatcagccagttgacaaggtactatatgcgattttgtatgtgatcatttacacccttgtcatgaacaagctgatcgtcagcggaacttcaaggattgctgttcagatcatcagcaaacattcagatgaaatccgtaattttgtacttacccagattgaccgcggtgcaaccatcattccagttcagggtggctatctgaaccagcagctgaatatggtactcaccgtcatctccaaccgtgaactcgtccaacttgaaaaaaatgttcatcagatcgatccggaaagctttatcatcgtttcccaggtacaggaagtccagggacgcggatttaatctggacaaacactggaaaccagagtagtcagatacctctgaaattcccggatttccggctcttttttctttgatttcaggcaggcaaaataaagactgtcctgcctggctggaaccagtggcaccgccgtaaccccatagtattctgcaaaggactttggtccgatcgcgattccgcttccgcttttcaccatcttcatcaccgtatcgatgctgtctgagcggatgactctcttccatgtgatattctgttcaccatatgtctttctgaggagacggtcttccaccgaatgctccagtcctgtgagcatagtatattccctgcaatccatgattgaagcatttttcttctgcgcgagcggatgatccggtgccatcagtatacactgcttctcacgaatcagttcttttgcaaaacagacacatttctccatgccgatttcattttccggcatccggtccagtgccatatcaagggaaccgtccttgatcgccgcatatgcatccagcccagcctccgtataaaatgtcacctcgagctccggatgcctttcaaaatatctggcaatcttcggaaacagtctgttggaatagactctggcaccaagtccgatttttaattttttatgttctgttcccaaaatcacttcttctttaaaacgattccagtcttttagcatttcttgcgctttttggtaaaaaacattccctttttcagtaagctccagtcctttgcttgtcctgtgaaatacacggtatcccagttccttttccagattccggatctgctgggacagagcgggctgcgagacgaaaaggtactctgctgcgcgggaaatgcttttgcaatttgcgatttctacaatgtaagttaattgttgtatgttcattcaacgcctctgttttgtttttcggtatataaaaatcccccatacgggacatttctgttttcttgacctgtatgagggtatcctattactattttttagcaggagtgcgtcctgcaagccatcctctgacggtttcaatatttgcttttattgtccgatcaatatgggcgatcgggcatgttcttgaaatccatctgcacttcgttgtcaataactgtgaattcttcatcatccataataattcgaagaacatactcacaggctttcctgtctttatacacttttgcctgcttctattatactgcctcattcatcgatgccagctttgctgcctggtctgctgcgatcaggctgtcaatgacttcatccagatctccgttcataatgctgtccagcttatgaagcgtaagcttgattctgtgatcggtcacacgtccctgtgggaagttgtaagtacggatcttctcagaacggtctccggtaccgatctggcttcttcttgcctcagcctctgcagaatgctgcttctccagttccagttcatataacttagaacgcagaagacgaaatgccttttccttgttctgcagctgtgatttttcagtctggctgtagatcacgattcctgtcggataatgagtcagtcgtacagcagagtctgtggtattgacacactggccaccgttaccagatgcacgcataacatcgatacggatatctttttcatcgatcacaacgtcaacttcttctgcttccggcatcactgctacggtaatggttgaagtatggatacgtccgccgctttctgtctctggcacacgctgtacacgatgtacaccactttcatacttcatacgggaatatgctccctgtcctgtgatcataaatacaacttccttgaatccgccgattccgttttcattgagggagatcatctctgtcttccagcgtctgctgtctgcataatgtacatacatacggtagatctcagccgcaaaaagggcagcttcatctccacctgcacctgcacggatctccacgataacgttcttgtcatcgttcgggtcttttggaagaagaaggatcttgagctcctgttccagctcttcgactctcttcttagactcactgagttcttcttttgccagctctttcatctcttcatcggattcttcctccagaagagaaagactgtcttcaatgttctgtttacaatttttatattctttatatgcctcaacaatcggggtcagatcattctgttctttcatcagcttgcggaaacgtgactggtcattcaccacgtccggttcctgaagctcacccataatctcctcataacgaatgagcagatcttctaatttatcaaacatttcttttcctcctgttatttgctacgcctattgtacacgccacataccacacggtcaagacctgccagatccttttgcgttgaaacctgttcaaatccagtctctttcagcaatttttccacatctgaactctggtcgtatccaatctccatcacaagccagccaccgtctgtcagatattccggaaccttttctgccaggatccggtaaaaataaagaccgtcctcttttccgtccaatgcctcatacgggtcatgaagacgtacctctgcttccagctcttcgatcacttttgtcgggatataaggtggattcgatgtgatcatgtcaaatgttcctgtaatattttcaaacatatcagtctggatccacttaccgctcactcccagctttttggcatttttttcagccactttcagagcttcttctgaaatatctgcaccttctatgacaatctgcggatttctcagtttcaggctgattgggatacagcctgaaccggtacacatatccagcacttttaccggattttcctttttcataagaagcagtcttttttctgcttcctctacaagaatctcagtatcctgtcttggcacaagtacatgttcattgactgcaaattcatatcccataaattcctgaaccccagtcagatgctgcaccggaatccgggtttttctgcagcttaccagctcaaagaaccggtcttcttcatttttcggcattctttcaaaaccatccacataatatctggtccttgtcatgccggtcacatgctccagcaggatccaggcatcactttccggctccggaatccccgccgctttcaattcacctgtggctttctgatatgcttcctgataggtcacagcttttactcctcttccttatatccgaaattctctctcaaatacgctttccagtcaaacaccgcttctacagccgcaatcccgacctcgatcatctcatcgtccggttcctttgtcgtaagcccctgcagccaaagtcccggcttacttaagatacacacgaccggattctcactgcttcctgcccatttgatcaactcataagaaataccagcaatcaccggaagaagtgcaattctcacaatcactctcatcagcggagattctacccttacaaaaaataagagaacgattcccacgatcatgacaaacagcatgaagctggttccacatcttttgtgttctttagagctctttctaacattttcaacagtcagtgaaagtccatgttcaatgcagttgatacacttatgctccgcgccatgatagcgatacaaacgcttaatatcgttcattaccgaaattccgcccacataggcaacaaaaatcgcaatgcggatgattccctcaatgataatccgaactgtataggaagaaatccatttcttcagcagatctgacaaaaaatacggaagtaccataaaaataccgattgcaagtgcaaaagatacaaccatcgtcagcgtcagcaaaagcttttccgtacgctcctgcttcttttcttcggcttcggtcatctctttttcttcctcttcctcatagaagcttgctgaccaggtcaaagtcttcatccccagcaccagagaatcaacaaaattaaagattcctctgacaaaaggtagcttcgtaagtgccgtatattttccaactacacttttatatgtatctgttgtaacttctatctctccgtcaggctttctcaccgcaaccgcataacgttctttattcttcatcatcacgccttcgatgacagcctggccaccaatattcgaagatttcatattctgttatgtcctttttaattcatcgtatacacaaaataggctgagatttcacaatcccagcctgttgaattctcttattactgaattccgtatttcttgttaaacttgtcaacacgacctctggcctgagttgctttctgctgtcctgtgtagaacggatgacatttagagcagatttctacgtggatttctttgcttgtagaacctgttacgaatgtattcccacagttgcaagttacagttgcctgatagtaatctggatggattccttctttcatgattttcacctcttcttgttttattcgttttacgcgctttcacgcggctaatatctttaaacagctatgttagcataacatagtttttttctaaatgcaagtaattttctaaataaactttgtttttttgaccatttggacaaattctacgttatttttcgtgcggtcaaacatattcagaatgctgtctaccgcttcatctgacttcattccgtttaatgcacggcgcataatatccactgcttcctgctcctctttcgtaagaagcagatcctctcttcttgttccggatttcgggatatcgattgcaggaaagattctcttttcagaaagcttccggtcaagcaccagttccatattaccggttcccttaaattcttcgtagatgacatcatccatcttgcttccggtatctacaagtgcggttgcgaggatagtaaggcttccgccctcacgcatatttctcgctgcaccaaagaaacgtttcggcatatgaagtgctgccggatcaagaccaccggacagggttcgtccgctcggtggaacaaccaggttgtatgctcttgccagacgggtaatgctgtccaaaaggatcacaacgtcctttttgtgctcaaccagacgttttgcacgctcgatcaccatctctgacacacgtttatgatgctccggaagctcatcaaaggtcgaataaataacttccacattatccccttcaatggcttctttgatgtcggttacttcttccggacgttcatcgatcagaaggatcagaagatggatctccggattattcttcctcatagaaagcgccacctgcttcaacagggttgtcttacctgctttcggcggtgatacgatcatgcctcgctgtcccttaccaattggagagatcagatccataacacgcattgcagtgctgctctttcccgcttccagtctgagacgttcatttgggaaaatcggtgtcatattttcaaagttcattctgcgtcctgcttctgccggagacattccattgatcttggtcagatacagaagcgcactgaatttttcagactgtgtctttactcttgtatttcctgtcaggatatcccctgtcttcaggctgaatctgcggatctgcgatggtgatacatatacatcttcctcgcccggcagatagttctgggaacggataaatccgtatccatccatgacttccagaattccattcaccgtacgtccactgtcgagctgttcaatatctgcggttccggctttttcagattttacttcctccttcgcctcttttattgaaactttgtcatcttcttccagcataagatcgatcagatctgcttttttcatcgttgaaattccgcgaagtccgcgcgtttttgccacctcttttaatgtagaaagaggcagggactcatatttttctctcgtcatatgttctatattcctcctttattccaattacttttcttatccaaaaaaatattaaacttttaacattgggaaatcttgtctgaactgactaatctgcttttgataaacccaagtatacaacattttgcacaaaatggaaagaagttttttgatttgctttcatatcagaagaatgttatcataaaagagcagcaaaactgtaatcaaaggaggacgtatgaaaatgtcagcaattgagcaagcacttgaaatgcatgaaaaatggaatggaaaaattgaaactactgcaaagtcacacgtaaactctcgtgaagacctcgcaatcgcatatacaccaggcgttgccgagccatgcaaggtcattgcaaaggacccggatgcagcctacaaatacacgatgaaagccaacacaatcgctgtagtatccgacggtagtgccgttctcggacttggtaacatcggagccaaagccgccatgcctgttatggaaggaaaagcagttctttttaaagaattcggcggagtcaacgcagttccgatctgcctggacactcaggatacagaagagattattaagacagttgtcaatattgcacctgcttttggcggaatcaacctggaagatatctctgccccacgctgttttgagattgagagccgtttaaaagaacttcttgatatccctgtattccacgatgaccagcacggaaccgccatcgtcgttctggcaggcatcatcaacgccctgaaagtaaccggcaagaaaaaagaagactgtaaaattgttgtaaatggtgccggaagtgccggagttgcaatcacaaagcttcttctcacctacggtttcccgaagatcaccatgtgtgatatcaatggaatcatctcagctgattcaccgaatctgaactggatgcagaaagagatgaccaaagtgaccaatctcgaccatgagaccggtacacttgctgatgcactcaagggtgctgatattttcgtcggtgtatctgccccgaacattgtttcccaggaaatggttgcttctatgaataaggatgcgatccttttcgcaatggcaaacccggtaccggagatcatgccggatcttgcaaaagctgcaggcgcaaaagttgtcggaaccggacgttctgacttcccaaaccaggtcaacaacgttgtcgctttccctggtatctttaaaggtgcattagagggacgtgcaccacagatcaccgaagagatgaagcttgccacagcaaaagcaatcgctggacttgttccggatgaagagctgaacgaggacaatattcttccggaagcttttgaccctcgcgtatcacaggtcgtaagcgaagctgtcaaagctctgatttaatcttatgaatacaagaacctatgatagcaatcgcccgcaggaaatatcctgcgggcttacttacaaaaaaggaactcctcagcgctggggagaacggcgctactatgcactggactactatctgaaacagaatttcggtgaaaaactgtacaagatttctttaaacggaggctgttcctgtccgaaccgggacggaacctgcggcacacgcggttgtatcttctgtagcgaagacggatccggcgattttgccgcttcttcttctctttctgttgccgatcagcttgcctatggaaaaggccttgtccgccccaaatacaacggacacagctatatcgcctattttcaggcatataccaatacctatgcaccagcctgtcatctgcgccggatctttaccgaagcgatttctgatccagaagtacgcattttatctatcgcaacgcgtccggattgcctttcacctgaaatccttacactgcttgccgaactaaatgccattaaaccggtctgggtagagcttggacttcagacgatccacgaacgcactgccaactggatgcgccgtggttatccactttccgtctttgagcaggcggtccattcccttcacgcgattggggtacagatcatcacccacgtaattttatttcttccgggagaatctgaagcagatatgctcgcaaccatccattatctgaacgctcttccgattgacggaatcaagctgcagcttctccacgttctgaagcataccgatctggcagatttttacaggcaggaacctttttatattccagatatgaactcttattttcatctgctcggaaaatgtatcgcttcgctccgtccggatattgtcattcaccgtctgaccggtgacggaccaaaatctcttcttatcgcaccgctctggaccggcaataaacggttagtactcaatcagatgcagcgctatttaaaagagcagaatctctggcagggaaaagaatatactacattttaaggaggcagccctatggcagaagcatttacactttataaactcatcattctatacatgctggacaaagttgattttcctctgaccaactcccagatttctgaatttgtcctggacaaaggatataccgattatttcaaactccagcaggctctttctgaacttgcggacggtggtctcatcctgaaagaatccactcacaaccgcactcttttccatctgacggaagatgggaaagggacgattcatcttttccgggataaaatctcaaagccaatccaggacgatattgaccactttttacagacaaaacagtatgatctgaaaaatgaagtttccgtaaaggcggattatatgaaaaatgcaggagaggaatattccgtgcgctgtcaggtctttgaaaatcacgaacccctgatcgatctgaccctttctgtaccgactgaaaaagaagcggcggcaattgcactcaactggcagaaaaaaaatcaagtcgtctatgcgtggctgatgtctcagttattgtgatggatgtgaatgatacggttcgcaaattaaggctgtgattgggcaatgatacacttgaatctcacgacatgaaaactctacgttgttctttgggcagatctcagctacgttcttgaaagcttgcaagcctcatgcctgctccaaaagagctgaatcccgggcgcggacagaaaacaaatggataaggattccatgtttgtgctatggagatgagacacaaaaattgtggaagcccttgctgacacaattttcgccttaagtggctcatcggaatggtcagcacaaaggaatctgctctatttgttttctgtccgcgtccgaccacaacctacaaaaaaagcagaccgtcccatattccgatctgcctaaataaccaccacaaaactgatgtatttcctttcttctatttccaccgtaatttctccgtggtaacgattcacaagcatctttgcattataaagtcccagtccatgcttttttccatcttctttcgtagaaaatcctttttcaaagaaatgactgatctcgccaagtcctatattttcgacctgattctttatcgtgaagataagcttatcattctgggaatcaatttcgatcagtacctgatttttttcttcggtacaggcttcgtatgcattgtcgatcagggttccaacaatctcgatcaggtggtgttcggaaatgccggaaacgatttctttgttccacacgcggatatcggtccggacatattccggcgcacggacaattttactgtaaataaatcctgccaggattttatcgctgatcttcagaagggggagatacttcctgctgtcatcttctctggcaatttccgtaatatattcagactgctttgctaccagttcttcataattgtcgatggtcagatgcatattcaggattgcattcagatgattgtcaaattcatgctgtttggcacggatttctttgaccagttcttccagcggaatcagatagttctgataaagccgcagttcattttccttctggcgtatcagtacataattacttctccagtccacaattccccagatcacaacgatcaccatcagaacaaacatgataaacaccctgtaatcaaaggtaccgctgatcaggaaatccacgatcagatagactgataccataagtgccattacgcagaaaatacgatatagaaatttgcgtacccaatcagccatttaacagtcctccgatcaccgatttgtaagtcacaccgatttctaccgtatccggacaatttttgatccggatgatccggttgacggtatcgtaatattcaacttcattcttattgaccgcatacatccgatggcactgcgcaaacatcccttttggcatcttaagcagcatctgtctgagagtcacataagggacatcccagttctccgtcacaagatgcagtcttgttcctctcggtatcgcttccagataacggatatcctcgcatttcagctgataattgatcccgtcttttttcacaacgatcaccggtggtttctccctgctctctttttccagcaccttctgaacaacctcttccacctgcttcctgtgaaatggcttcataatgtactggtaacagtgcagctcccggtaagcctgcatttccatattgccaatggcagtcaccatcacgatcggggtaaaaatatattcaaacctctcccgtatctctcttgcgaacaaaatcccaccgatatcctctcggtcctcgccgcttagatttacatccaaaaggaaaagaccataccggatttcctgatccagcaggtcttttgcttctttcagggaagatgccttgtggacacggatatcatctgaatatgtggtaagaatctctgacaatgcctgcagcgaagtcagttcatcttccaggatcaatacatccgtcatctatttgtcacctttcctctctctttttttaatctaatcttccttgatcacttctttagcgctctttacaagccccgcaagtgactgcagttctgacggaatgatgattttcgttgccttgccgtctgcagccttttcaaatgcctccagactcttgatcgtaagcactgcctggtctgcacccgcttcacggatgaaacggataccgtctgcatttgcctgctgtactttaaggatggcttccgcttcaccttcagcctctttgatcctcttttctttttctgcttctgcctggaggatcgctgcctgtttttcagcttccgctttcaggatcacagattctttttcaccttctgcaacaaggacagtagatttcttttcaccttctgcacggagaatagcttcacgtctttcacgttctgctttcatctgtttctccattgcatcctggattgctgccggtggaatgatatttttcagttccacacgattgactttgattccccatggatccgttgccacatcaagagatgctcgcatcttcgtattgatcgtctctcttgatgtcagtgtctggtcaagttccagatcaccaatgatgttacgaagggtggtcgccgtcagattctcgattgccatgatcgggttcgctactccgtagcagaacatcttcggatctgtaatctggtagaatacaacggtatcgatccgcatggttacattatcctttgtgataaccggctgcggtgcaaaatcaactacctgctcttttaaatctactcttcttgccacacgttcaatgatcggcagtttaaaatgaagtcctacactccatgttgcctgatatgcaccaagacgttcgataaccagtgcctttgcctgtggcacgattttaatgcaggaagtcagaaacagtaatgcgatcacaataataattactaaaataataagtcccgtcatcttttagtcctcctcatatttttttacaattaactttactccggatatattaaccaccttcgccagtgttccgggttccaggatcacgttatcctgttcggatcttaccgtccactctgtaccatttaccaccgccataccagtctgccctatgttatctactttctggctgatccggatcgtctttccgatgattccttcatagttcgtcttcagacggcgggtgttaataaaacgcattgcaaatggtctggtaaatacaagcagtaaaattgtcacaataaaaaatgcaaccacctgtccggcaaacggtacatccagaatattcaggatcagtgccgccagcgcacctcctgctccccagatcgttgtaagtcccaccgttatgatctcgatcaccagaagtactaccagaagaaccagccatgcaacagttatatagctgtcctgaactgctcccatattcttcactcctttctgcttacagatatggtagcagagtgtctgtgtcaaatcaatcccttctgcgtgaatgcagtgatttcctgtgcgaataggttacgcttcatccttaatccgcttcatatgcgctttgatcgtttgttcgtagccgttatcgctcgcttcatagaatacggcatctttgatctcatccggcagatactgctgttttacataatgattcggataatcatgcgcgtatttgtaaccaattccatgccccagctttgcagaacctttataatgtgcatcctgcaaatgcaccggaacagtcgttttatattttttcacattgtccatcgcagcaaagacagcattacatgctgaattactcttcggcgctgttgccacataaagaactgcctgtgataaaatgatctgtgcctccggcattccgattcgctccactgcctgtgctgcactgactgcaacattcagtgccatcggatccgcatttcccacatcttccgatgcacagatcataatcctgcgggcaataaacttaatgtcttctccggcatacagcatctttgccagataatatacggctgcatccggatcagaaccgcgcatacttttaataaatgcggatatggtatcataatgattatctcctgtcttatcatatcgcacaacccgcttctgtatacattcggatgcaacctccagcgtgatatggatcattccatcctcacttcttggtgtggtgaggatacccagttccaccgcattaagcgcagatctggcatctccaccggcaaggtctgccaggaaatgcagggcatcctcctcgatcaccgcatgatagcttcccattccttttttttcatcctgcaccgctctcagaatcagggtctctacttcttcctgtgaaagcggacaaagttcaaatacactggatctggaaagaagcgcaccgttcacctcaaagtaaggattttctgtcgtcgcaccgatcagaatgatcgtgccgtcctccacaaacgggagcagataatcctgctgtcctttattaaaccggtgaatctcatcgatgaaaaggattgtccttttctggtacatccctttcagttctttcgccttattcaccacttcttccatatccttcttcccggcaaccgtagcattgatctgggtaaattctgcacttgtagtattggcgatcacctttgcaagcgtagtctttccggttcccggaggtccgtaaaaaataacagaactcagtttatccgccttgatcgcacggtataaaagcttgtcctttccgataatgtgctgctgtccaaccacttcatccagagtcgtcggacgcagtctggaggcaaggggcgattctttctcctttgtcgtctcccgcatataatcaaataaatccatcaaaacctctcctttaatccagcagcaattcatcgactgtcacaaattcatatcccttcgcctgcatgatatcgataatgcgaagtgccgcctttactgaagacagataacagtcatgtaataaaataatatcattttcctccgtttccgtcactactttattgacaatttctgtctcattatccgtattccagtcaagcggatccacattccatagcaccgcaatcatgccggtattctcttccatctccttcttccaggctccatagggcggtcgcatatattccgtcttttttccggtaatttcttcaatcgcggtattggtctttccgagttcgcactctgtcatttcctgagacatttttgtgagatctacatgactgtaagtatgatttccaataatatgcccttcttcagcctctctgctcacaactttcggatattttactacattttccccgatcacaaaaaaagtaaccttcacattccgcccggcaagcccgtcaaggagcactggcgtactggaaggatgtgggccatcatcaaatgtgagggcgatcttgggcttttcctgatactgctcgtttgttccacctgcctcataggatgcttctaccgtttcatcattcattcttatcagtttgatctttccgttatcgatcactccccaggtaaacagaagccatgtaaagcttaaaaaactgattgttccataaagcagtcggtaccacatacggatatccctcttttcccattctctttttactatatgcgggagattctttacctatgtactcacatttatgctttcttgcctccggtactcttgcattaaaaaaaatatacagaacaccaatctcttcctgttttctatactcagatcaaaaaaggggatatcaaccagcttctgctgactcatatcccctgaatgatctacattgcttttttataaagttcaatgatatccctgatcgtagactgtctcggatttgccatgatatttccgctcttcatggcatcggcagccatcagttcaatcttatcttccgttacaccaacatcggcaagatgctgcggaataccaagatcacgaagcagatctctcgcttcatctaccagcatttccggaacaaaatcgatcaccgggtctttttctttgctgatataattgtagatcttctcataacgtccatgatctgcaagtgcattatattccacaatcgttggaagaagaatcgcatttgccacaccgtgtgccacatggaaataggcgcttaccggatggctcatagcatggatatttccaagtcttgcccatgcaaatgcgatacctgcgaacatgcttccggagagcatggctgccgccgcctcttcgtcctgacggtttgctacgaatctgcgcagatttgcaccgatcagttccattgccttttctgccattgcatcagaaaatggagatgcatctcttgaagtgtaagcctcccatgcatggatcagtgcatctacgccacatgctgcggctaccgatgccggagaagtcataacaagctccggatccagaagtgcatagcttgggatcagctcatagctgaacacagtcagcttataatttcttgcttcatcggtaataacagaaaatgccgtcacttcacttcctgtacctgctgttgtcgggatcgcaatgatcggaacgatcggtcccggtaccttgtgtgcaccttcataatctccgatctctccgccgtattttgcaagaacaccaactgcctttgccacatccattggacttccgccaccgaaagctacaatactggttgctcctgcttttttgtatgcttctgttgctttatctaccgttgcaacagatggatttgcttctacatcagtaaatacttccacttcgataccggaagccttcacgatctcttcgactttctcgaccattccgatcttcttcaaaaccggtccggaaatcagaagcatcttcttggaaccacttttctcaagaagctccggaagtctctttaaactgccttttccaaaaataatatcctgtggtacattgaatgtaaaatctttcatcatctactactccttttaaataagaatgtgcctcggcacattctcgcgccgagcgcgttgctgagcgccagtggcgctcgttaagcaacgaccgaagcagagcgtagaccgcttgcgacattcttcatcttcgtgcgagtgcgcatctccggcacgcagtgccttttgtttcataggaagttccttcggaatttcctatgaaaaaagacgagaccgcaccttagcagtctcgcccttgagtttctacttacacagcatataccctctgtcatttttttgtcaagaggattttctgtttttatttcttctttttctttccattcttctttgtcggctttttcacgctatagccaaatgttccgagcaacttacccagactataatactgtccgtgcacatatacgatcggatcggtcttttccaatgcaaatcgccctttctgatccatataggcatcatctacatgaaccgcttttacctcggcaaggaaaatatgatgcgatcccggtgtttcttttttgaccaccttacactcgatgttgaccggactctccgcaatcagtggcgcactcacatattctgccttttccggtgtcagatgcagctctttgaatttgtccacatcttttcccgaacgcacaccgcaataatccgttgcatacgcaagtttttccgtcgtcagattgattacaaattctccggtctcatcgatcatgtgataagaataccgctctggtctcacggaaatcgaaaccatcggcgggtttgtgcagaccgttcccgcccacgccacggtaatgatattcggattgccttctttatctgccacactgaccataactgcaggcagtggatacagcatatttcccggcttccagatctgttttgccataagccatctctcctataaagttatctgtttttatttttgctgcaggtaagttaccagaacagggatcatctgtttctttcttgatactacacctttcaggagaattttttccgtatctcccggcagttcaaacgcttcaagaacctgttcctttgcattttcaccacagcaaaggagttctgtagactcttccagaatattagtcatcatcaaatacaacatatgcagtccctgggtctttctcgcctcttccagatatgggatcagacgtcctttcacctcatccagttcatcctgattcatggatgtgatctgtccgactccaaacatgatatcttttacattgaacaccttaaagtcctggaaacagatctcttctacggatttgccacgcagattgcttcccgcattgaacatctcttttgcatgttcttccatatcaatcccggctatccgcgccagtgcctctgctgccgcctgatcaaccatcgtacaggttggtgaacggaacagtaacgtatccgaaataattgcagagcacagaagtcccgccatctgtggctctacctctacaccgctttcctgatacatctggtaaatgatcgtagcggtacatccaaccggctgattccggaaatataccggtccgattgtctccagaccgcccagtctgtgatgatcaatgatctcctgcacctctgcctcttcaattccattcacagcctgtgatttttcattatgatccacaagaatcacctgttttttacgggatgtcataagtcttcgtctggagaggaaaccacagaactttcctttattatccagaattgggaaatctctgtacttcgtctttgacataacttctttcacatgttccacataatcattcaaatgaaaaatctccagattatcacggctcataaaatacttgaccggaatactctggttaatcagccttgcagcagtaaaggtatcatgtggtgtctgaataatcacgatatctctctcctctgccatcttcttgatcgtcttggaaatattggctccctggcagatgaccagacagcttgcatccatctcgatcgcgcacagctgtgactcataacggtttccaagaatgacaagatcatccttctcaataaaattctccatcagatccggactggatgcggcaatgacaacttttccattcaggaaatagccatgctcattcccggagatcagtgttccgtccagtgttttgacgatattgcggtactgggttctcgctgttgcaaggatattattatcgtacacttccatatatgacgtagcaatatctccgatagtgatcagcccttccagcttctcacctcttgttaccggcagtgtcttaatattctcatctttcattcttgcccatgcgtctttaatggacatgtgaccagatacaccctcaatatgacggatatccatatcttttacctgaaggtgtacattgtccagaagagacggcacacttacctggaatttatccagaacatatgctgtctcaccatttacctcgcccgctcttttcgctatgtatttttctcctgtgattttatttttcagatttgcatatgcaattgccgaacagatagaatctgtatctggatttttatgtccgatcacatatactttctttggttttttctgatccattttatattactccattactccattactatctcttgttcctttatttttcagaatgccattttttttactgttcgtcaacccttgttcggataaaagaccacttacactaaattttaaacaatatctctaccagtgccttcggtctgccacccgctgccgctgtcttctttgcatacacttttccataaccggcttccatgatcttattcatgatccggcgcgcacttctgaccgtaattcccagacactccgccaactgatgtgcatcgaaaatataactttttcttacatctgcaatggcaatgatcttcagaattgacgttgtgctgagcccggttttttctgaaattttccgtagcttcggatcggaagaaatgagctgatattccagctggatctcctttccaagcggtccgtgctgtgtctgaccggcatcaatccagaaaatctcctgctttgcatttttcagggaaaaatccagtgcacgtcttgcgttcatttccgcgtcattcatcgtgcctccggttccgatccctacattcaggctgattttcttctcctcctgcacttttttttgcagattcagaagcttccgctggttaaattcttcttgtacagccccggaattggaaaatacaatatattctcttcttcctgatgcaaaaattgcaccttgaatcccttctgtatatttgatgatttctttttcaatatctgcttttgcaagcatacttgaataataattctcttctctgctcttataatccgtcagctgaaaaatctcaactgctgcctgcgcatattctgcttcctgaagcgcacattcattttttaatttttccagtgccactctcacttttgccctggtcggaggcagataaattgcatggtatcccttttcctgcagtgtcttatacacccaccgaagagaagtcagtgccacattgatctttccttcatccagaagcttcatgtgccactccacatactgttcttcttccactcctgcctgaaacggacaggaataaatgtttcttgccaggatgtcaaatgcatccagcaaatcctcaatgacctgtttttctacaatatcaatactaaatgcatccagttcaatattacttttctgcatctgcagaaatgctcccgcaatgctgattaccgatttttccaccgacacatgcggcctggtgaaatgatagtttctccccacaaaactttcgatcgcacagcccgtaaacagtaccgcatcacactcctgttcacattcctcaatcagccggtcacttcggttaacctgttcctcttcataagaagctacttctactgaactgtcgatttcttttatactcttcttaacaacctcacaagatgattttgatccgataactccaactttcacaaatttgtcccccgtattgcgatcttctatccagagaacctgccgttggcagcttctctctatatatctgaataattgctttaaaaaaggaacccctcaaacgggattcctttttattataactcagagccatcaaaaaccacaagcttagaatgctctttttttaattccagataactttcttttgtcagcgtcggtttgaaattgtcaagaatctgttttgccttttttgcgttatcataaagaagatcaatgatcgtaagcgccatcatctttgccggaacgatataagcaagttccgggtccgcaagacggtaatccttggagtgaagtcctccggttattccctctgtccagatgtgcatacacggcatgaactgagaaagatcccccagatctgtagaacctgctgtctcataaagctctacaaatgaatctttttccgcccctgtatattcgatcatattttctttatataatgctgaaagctcacggttggtattcatcggaagatatccgatcttatcgtcaatctcgacttttcctccgattgcaagtgctccggcttttaacgcacggttcacttttttactggcatccagcattccatcaattgtgaaagcacgtaccatgatctgcatcttcacaacagcaggaactacatttaccagatctccgccttctgtaatgattgcacttacacgaaccttttctttctcctgaaaagtctcacggagtgcatgaatgttgttcagtgccaactctgccatatttaacgcattgattccttcatgtggtgcgaaacctgcatgcgcagcttctccgataaatgttaccgtctttgtcacaaatccgttgcagtcggtatcaatcacgcaatgcctgccatttccaatttccatcatgtgacactgcaatgccatatccacatcatcaaagccaccacgttttaaatattcctgcttgccgccgtaaaaactgatcttattttcacggatcagactgtcgcgataatcataatctacgcattcttccgcagggatcgcaataaaatcaaccgctccacccagttccttcatcactccggatcttaaaagaccaatcgcacatccatacagatctgcaagctgtgcatgatgaccgcaggcatgaacatttccttctggcgtactgtccggatgttctttgcactggatacagtccagctctccgatcacagcaattcttgtattcccttttttcggagttgaaaccttacagccagtatatgcaatttccgtctccggctcttctccaatctcctgaaatgcctttatcattctttctgtagtcttaaattctttgtagccaagttcaggcgttttatatacatcatcaccaagctgaatgatcaaatctctgttcgcgtcaatcgcgtccagacatctctgcttcagttcttctttttccatctatgtcgtcctcctattctgcacccatcagtcttctcagtacttttgtcactttccaggtctcatctgtatcaagcgcttcttctactgtgtgtacattgatcattccacatcccaaaatgacgctcttatatccgtgtcccgcaagcacatttgcatcacttccgccaccgatgatcattttatttgctgtaattctttcttctgccattgcatttacagtatcctggatcaattcacaatcttcttccagcgacaggaccgggtaagccatctcatgcttcatctcataacaggctcccatttcctctacagcttccttgcagcactgttccatatgtgtaacctctgcagccagcttttccatactgtgtgaacggatctctgcggtaaatgtaacctcatctgttacgatgttggttgcagatccaccttcaatatgtccgatattagaggttgtctcataatcaatacgtccgatgtgcatcttactgattgcctttgatgccacaacaattgcattgattcctttttccggttcaattccggcatgcgctttctttcctttgaaagtaatctcaatcgcttccattgccggtgctttgtatgcgagagtctctgctccaccggttgcatctacaacaaccaattccttgcatggcagcatagacatatccatgtgctttgttcccatcatactgatctcttcggagcaggtaaatacaagataaatatctctgtgcggtacaccgctttcaatgatatcttctaccgcttccatgattgctgaaattccagctttgtcatctccgccaagtgttgttgtcttgtcggtactgatgatgtttccattgatcaccggatttacatttctgcaaggctcaatctgatccatatgtgctgcaaatccaagtggacgttccttcgtatttccttttacaaatgcaacgatatttctgccgtttccaccataagcttccccggcatgatctgactggaacggaatgttccgctctctcagccagttttctatccagtccgccatctctttttccccttttgacgggctgtagatcttgatcatctcaataaatctttcctgtaatctttctctcgataacatctttttcctttccggacttagtcctcaagctctttcttgtagataatctttcctgcgaaaatagatccaaatacggctaccaggataacaacgtatgacggtgttccagggaagaaggataagaatccgtttttcatcagccagttcattgcaaatgcgataacaaccgctacagcaccaagcttcggtcttgtgattgcgaactgtccgaatacagctccgtaaagtgccggaagaaggaagttgagggcctgcttgaatccttctggcatcataccaataattgcgtttcctgcaattgctccgattgtcagaatcacaatatttacaatgatcgatacagcaataccgatggttgatacaacagaacctttgtcactccccatttcaacgcctgctgcttcctgtgcaacagaagaacacggaacacgcatgttggatgtatttcctgaaaggaatgtcagataagttcccgggattccaagaatcgggaaataggaaatcggttctacaatataaaatgctccacttacactgatctgtgcgattgtacctgcaatgattgcggataccggtggcatatatccgtatacaactgagataacaagtgccggtccaaaacatgtaatgatacctaataacatggtgatttttccccatttaacaatatcaggtatatagactttgttgtagtattctttattcatatctttatcctctcattcctattaaaatacagtgttccagatgtaaccaatgagcatgcctgagaacatggaaattgcaaaggcccattctctgagccatccaatattcttttctttcgctaactttgtcagggtcatcataagaatgcatcctacgattgttgcgattgccggtgctccgccaaatgcaaactgattcttttcgttgaagaagtttcctgatgcaaggtttgcaaatgcaccaagcatcgctcctgctgaaatgatcggaaccattttggaatttccttttgacatcagatgatttactttatccatcttatctgtgaaaaggagtgtgaagatcagccatccaagtgaaccacagatcatggtccatacaccacaggcgaatgcaaccggtgtcaggttctccagtgtagcgcccattgcctgtgcgccaaatccggctgccattgcttcatagttaacggatccgatgaaagaaagtctcatccatgaaacaggtgctcccattgatacgatcagggagatcattgttaccaggattacaatagatggtccaattgaggaaatggcactactcttaattgccatattgatcttttcctgttcaattccaatctcttttgctgctttgagtgacttcctgaaaaacagtacggactgaaaaactacgattcctactgctattgcggcacccacccacatcagagggctgtttgccagttccagataattcacgtttcccttcattttaaattctcctttgccttttagtttaggacactgcccttaacatgtccttatgttgataatatacaatttattttttcttttgtcaatttttttcacaaattttactattcaaaatatacacaaatttttaccacaattttcgtacataataacgattttttctcattaagcacaatttaaccgtctaaccatctggaatccatactttttatctatacaaaaatgtgttatactaataaacatattgagcatacgttcagaaaaataaactaacagaggtgttaagatggaaaacgaaaaattacaggaacagacagaaagcatggcagactacgaagcacatttcgatgatgccaatccatggaatgtggtcgcacgttatcaggaagaaggaaccaatcttcacgtaaaagtagaaggaatcgtaaatggtggtgtcatcgccatggtcgaaggacttcgaggattcatcccggcatcccgcctttctctttcttatatcgaagatctggagacttatcttctaaaagaaattgatgtccgcgtgatcgaagcaaaccaggcagaaggacgcctgatcttatctgcacgtgagattttaagagaacagaaaaaagcagaagatgcaaaaaaacttgcatctgtacaggttggaagtgttgtaaaaggtaccgttgaatcgcttcagtcctacggtgcttttgtacgtctcgagaacggtctttccggtctggttcacatttcccagatcagtactcagagaatcaaatcagcagaccaggtacttcacgttggggacgaagtagatgtcaaagtcatcggtatcaaagacggtaagatcagcctcagtatcaaggctcttgccgaagatgctgaaaaagaacaggaggaagagctggaacacgtagaaattccgaaagtagaagcaatcggaaccagccttggggatctgtttaaaaatatcaagctttaaaaattataatttaaaaaagggaagcctgcactttcgcagacttccctttatcattgcctgataagtatcactgacactttatgcgagaatgtaccccctgtacattcttttctatttttccagtgcttccagatcctgcatccagactgccgcacacgcatcgctcggcattctccagtctcctctcggtgaaagtgccaccgtaccgatcttcggtccgtccggcaggcaggagcgcttaaactgctgcgcaaaaaatcttcggtaaaaggtcttcagccatttcatgatcgtctcgctgtcataagttccttcaaatgcaagctttgcgagccgatagatctttgacggttcaaaaccaaatctcagaacataatacagataaaaatcatgcagttcatacggacctacaaggtcttctgtcttctgggcgatctcgccatccttcggtggaagaagctccggacttaccggtgtgtcaagaacatccagaagtacctctttcagctcctgatcctcacaggtatccgcataatactgaaccagatggcgtaccagtgtcttcggaacagatgcattgactccgtacatagacatatgatctccattataagtcgcccacccaagagccagctccgacatatctccggttccgatgaccatgccccattcctggttagcaatatccatcagcacctgggtacgctctcttgcctgtgaattctcataggtcacatcatgtacctcttcatcatgtccgatatcacggaaatgcacatggaccgcatccgcgatcggcacctctttcaaagtggctcccagcttcttcgacatcaggcaggcattctgataggttctgtctgtcgtacctaagcaaggcatcgtcactgcaatgatatccttgcggtcttttcctgccatgtcaaacgctttcgccgtcacaagcagtgccagcgttgaatccaaaccgccggaaattccaacgactgctgttctcgagtgagtatgcaccagacgcttcttcagtcccattgcctggatcatcagaatctcctcacagcgcttttccctctctgccatattctgtggaacaaaaggggtctgtgcaaagcttctggtaagtgctgtctcttccacacttatatggaacagtacttttggaagatgacgttcttccgttgtctggaaagttgtattttttctccgttcacttaaaagacggaaaatgtcaatctcgctgacgatcatctcgttggcaaaccgctttgcttctttcaggatcgtcccattctctgcaataatattgtgtccgccaaatactacatccgttgtagactctccgtccccggcatttgcatagacataacccgcaatcagtcttgcagactgtcccttgatcagttcctcccggtaactatcctttccgatcgtctcatcacttgctgaacagttgaccaggatgatcgcgccttctcttgccgcctcaatgctcggcgggattggtgaccagacatcctcacagatctctgccgatacgaccagatcatccatctctgccgcctgatacaggatctgcggcccaaacaggatttcttccccttcataagaaatcactcttgcttttttcggtccctgacggaattgacgcatctcataaaattccccataattcggaagaaatgtcttggttgtaaagccaaggatctttccgtcatttaatgcggccgcaacattataaagctctccatcaattgcaagtggaagcccaacaaatacaagtgcttctgtatgcctggtctcttctgcaacttttgcaagtgctctgcgcacctcttttaacagtatatcctgtgtaaaaagatcgctacaagtatacccggtcaggcaaagctccggaaatacaatgatctttgcgcctgccttctcagcttctttcatacgtttgcagatttccttacagttgtgccagacatccgccacacgaatatcaactgtgaccgctgcaactttgataaatccctgtttcatgtgtttaccgttactgaaaacttataaaaagttacaaacttctatgtttcattcctactttaacgagtatgcttttgatgatataactatctatctactcacaagttcttgtactctccataggcgtaaattccggactaacgtatccgtacatatttgcattatttcgatactgaagataaaagtttttcccgtttgggtaacgcatgattccgtcttccccgattggaaaatttactgcacgaaatggatcttcatgatacttcttgtcagtagtctctttcttgaacatgggaaacttcatatatttttccattccctgttgctcacagaagatgtaattattgtaagaaccatatccggcatctgctactgggtacttcagatagaagccatatgtagtataaaacttgttcattaatggaataaaacaatccatatctgagcgatactgatttacatcaacaaccacaatatattcatctgcaacaccgacctgtacattataagctggaagcaactggtcatttcccatgtagtctgtcttgattcgcataaaagtggctgaatgatctgttttcgagtagctgttgcgattttctccacagattttgattttttccacgtattcttccaacttagcagcatactctttgagtttctcataatgacgttgttgtgtagttttgcgatgtcccctgccatgaacaaacattgcttcattaatctgccagacttctgcatactgttcagcaacttccttcagatactctggtgcgtactcactattgatacaaagtttcatacctatacatgaaagttcctcattgatttcctcaaagagtgtagtgatcttaccaaagagacggtatctggatttttcggttgctttttttcatacccaggagtatttattcgcatttgcttcaaacttggatccatcaatgtatagatgttgaagatccacatgctctgtctcgaagatttttttgtttatatcttgaaatatttcttcaatgaaatcagcaagtacttcgttgatgaagtagccgaaagtgcggtaagaaggtgcttgatgatccatgagatacatgaagcggagattgactttacattgatcctccagttcacgcaatgatatatagccattcgtcatgaatccaaacaaaactgttttcagcatgctgaccgggtcatatctgaatcttcctgtataatgttgcggaatatttttcagatatttctccagttcgattcctcccataaatctgtcaaaagtcagcaccggatcacaaacgtccagataatttttttcacaagttaattataacagaaagaaagaccttgagttcattataaactcttggtctttcttttctttcgggactattcttttttcacagcccctttttttctgcaaaaacatgaagatatttgttcctgttataataaaaaatctttgttgtaaagattggagtcgcaagttaatatatgatacatatggcggaatgaagagatctattttctgtaaaaaagtataatgagaatatgagtatccgtaaaacgaaaggagatagaagatgaagataaaatcagttgcagttttaggtgcaggggcggtaggctcctatgtgatctggggactttcacagaaaccggaagtccggcttggcgtgattgccgagggagatagagcggatcgtctaaggaaaaatggatgtgcgattaatggcaggatttaccatccggaggtgtggtcaccagaagaagcacataatgtggatctgctggtggttgctttgaaatacggttcactggaaggcacattgaagagtatacaaaaaacaacgggtggacatacagtggtcatgagcctgatgaatggagtcgacagtgaagaaataatcggaagaacagtgggcacggagcatgtcttaccggcactgatcaaagtggcttcgcacaaagaggatgatggttatcattttgatccgccgaccacactggaaattatttttggagagccatctgcaccgtttgacagtgagcgtgtgagagcggtggaagcgttgtttacagatactgggattcatttccggtcgaccgagtacattcaggaggagatatggtgtaaatttcgcctgaatgtatacaacaatctgccgcaggcaattctggggacaagcgttggatgttaccgcgacagtgtccacatgaaagcaatcagtgatggattaaagagagaactggaaatggtagcgaaggcaaaaggaatcgatatgagtaaaacaggaagttcatccggacgcggaagcgtagttcctccgacagccagatattctaccttacaggatctggatgccggacgtcatacggaaatcgatatgttctccggtgcgcttgtgcggatgggaaaggagcttggaatccctatgccgtacaatgaatatacttatcatatgatcaaagcgctggaagagaaaaatgatggtaaattcaattataccgggaatcaaaaaccaatcatcgaaataactgtaaatgagaatgctgtgatacactttgaactctggccggaaatcgcaccgattgcctgcggaagtgttatgcagctcgcagagaagaaaatatttgacagaagagccattgaacgtctggaaccgggatttgtcctccagccactgttttttgatggtgttgatccacagatcgatatcatggtcgaaccggaatttaaaaccaatcctgaaaatgccaaaatcgtttttgaacgggggattgttgccatggcaggagatccagagaacagttctggcagccagtactatatcactcttgctgcttctgagagattgaatggtaatttcactgtaatcggaaaagtgatcgatggctgggatgagattgaacgactggaacatgtagaagtagaagaagccattgaaccgcagtcaggatttgtctatcacagaccggtaaaaaccgagatgatcacgaaagtcagacgcataaaataaaaaataaatccttcaataacggagatgtgttatactataaccagcatgtattgaaaaatacaacataatccaaggaggaaaccaaaatggggaaaaaacggattcgggactttgggattgtacccggaagagtaaaaacaggagaaaggaatgcgattacggacgtgccaggtgtacgggtagggcattgtacggtgaagacagaagaaaatcataccggtgtaaccgtgatcgttcctggaccggacaatgcatttgccaagcactatacggcagctgcatacattcataatggatttggaaaaagtgctggcgtggtgcaggtagaggaactggggaccctcgagacacccattgctcttaccaataccttaaatgtcggaaaggttttggatgcaatggttgatgtcgtgatcgaacagagccgtaaggacggaattgagccacagagtatcaatccggttgttggcgagtgcaatgactgccggatcaatcatatccagaaacgggcgattggcgaaaaggaagtgcgtgaggcttttgcggcagcatcagaagaattcgaagaaggtgatgtaggtgccggtgccggtacgacctgctatggcatgaaggggggaatcggttctgcatcccgcgtgatcacgattggtgaaaaagaatacaccattggtgttctggttcagtcaaactttggtgcaacggaagattttgtactgaacggagaagctgttggtccgaagattctggaatggaagcaggaaaagagtgatatggctgcatttgaagaagataaaggttctattatgagtattctggctacagaccttccattgacaagtcgtcagctcaaacggattctgaaaagaaccggtgttggtatcgcacgaaccggcggttacacaggccatggcagcggggaggttatgatcggatttacgactgcaaacagaatcccatctggttatgaggaggaacttgtgcaaatatcagcaattccggaaaatataatcgaccgtgctttccttgctgcggcagaagcagagcaggaggcaatcttgaattccatgaccgccgcagagcagacacgtggaattgcaggtgaactgtattacagtcttgcagaataccttgaggatagagaaagctaaagactgtacaaaagaataagtgtaatatgtgaactactcggtaattgaattaccgagcttccgccaaaaaactcctcgcggaatttcatggtttcttttgattcctacatacgcgggtgacatattatgggatgactgcgaccatccaaccccctagtgatgaaggctaatcccggcgtccctaccggtttttctatcaatgttctattttatgcagataacaggatccgcaatccttccagatcaatgttgatagctgcctgctcatcccaatcgatgagatttccacagacagggcaaacataagtccggtcagaaagctgcagttctttgtggacatacccacactcactgcaggttttgctggatgggaaccatttatcgatcttgatgatgtaacagccgttccgtttccctttatacaggagcatggtcacgaacattccccatccattatcactataggactttccaagattgagtgtctgtttcaaagcagacatatccagaccgatgtgcttcatatctgcagacggttcctggtagaccggctctgtttttgggtactcaaaggagacggaacagtaccacttcttgaattagcattggcaaaactgcctgttttgggttagaatagattatgttattaatttttttcacaagttaattataacagaaagaaagaccttgagttcattataaactcttggtctttctttttttcgggactattcttttttcacagcccctttgcatatacaaatcaaagaagaacctgccggtccgattattttatatcaaatctttcttttatcactaaatcctatctcttacatatactaataccacatctgatcgaattatttttcaaaagaaatcttccttaaaatccccaaaaagaaaggcaggctatccagataatggagcaacttatggattatgtaaaaccggaactgctgatcgtagcggcagttttatactttttcggaattgcactcaaacaggcagaattcatcaaggacaaatatattccgatcacgcttggagcgacaggtatcgtcatctgcgggatttgggtgacatctaccgcacatttcgcaggagtacaggatgtgttgaccgcagttttcgcatccgtaacgcaggggattgttgttgcaggactgagtacctacatccatcagatcatcaagcaggcaggaaaagaagagtaggagtagaagtggtatggcattaaatggaattgacatcagcaactggcaaagtgggatcaatcttgcggttgtcccgtgtgattttgtggtgattaaggcgacagaaggaaccggttatgtaaatccggattacgaaagagcctaccgtcaggcgaagacagcagggaaatgcctgggcatttatcactatgcgtctggtggaaatatacaggcggaggcagaatattttctgaagaatgtagggagctgtgtgggggaggcaatgcttgtgctggactgggaagggcggtccaattcggcatttggtgtgaatgaccgggaatgggtgaaagcctggtgcaattatatttcaacaaagaccagcgtcaatcctgtggtttatgtgcagcaaagtatgatgagccggttgcagaatatcggaaactatggactgtgggtagcgcagtacgcgagtatggagccaatcgggtaccaggaaaatccatggaatgagggtgcatatgcctgtgtgatgcggcagtacagttcttcgggaagattaagcggatggaatggcaatctggatttgaataaattctacggagaccggcaggcgtggagccggtatgctggaaaaggaaaccagacaactccagagaaaccttctgaagaggaagaaaaccaggaaggaactacgctggatctggtttttcggacgatgcgtggagaatttggaaatgggaaagaacggaaaagctggcttggaaccagatatggagaagtgcaggggatgatcgactatatttccggtgccagtacagaggcactggcaaaggaagtgcgtgccgggaaatatggcaacggggaagtgcggaaaacggttctggggaaacggtatgaagaagtacaaagcagagtcaatgccgaagaaaacaagtatcatatcgtcaaatccggggatacgctttcgaaaattgcagcgatatacggaacatcttatcaggaaatcgcaaggttgaacaaactacaaaatccgaatctgatttatgtcggtcagaggctgcggattaaataatcggctaatagatttgatattcagaatctggtctttgaattcagtaatttggcaaaaagagctattgttttcagctttttggtgtgctatgatgaaaaaaatgaatacacaggaggttttgggatatggataataacttaaatgaccagacaactgagaatagtgaaggggaggaaaagagtccatcttcttacaccgatcccaatgcaggatatacagaagcagagccgcaggcaaagaatgacaatagcgtgccaaaagaggcagcggacgataatttaaagcaggaagaaaaaagtcatccggcatatacttatggtgaaatgccaaagtcagaaaacggaagcggctacggacagtcagcaccgggcggaagcgcttgccattctggaacttcggatggaacttatgaaaataatacttacaacggaaattcgtattataacggaaccaatcagagcggagcttataccaatgggtactctgacaaccagtatcagaatagcggttataataccggatttaacacgagcggctacaataacaattacaatagccagaacaattatcagatgccgccaaagcagatggatctatctccactttctaccggagaatggcttttgacgctgattgtcggaattattccatgtgcgggactgatcctgtatattatctgggcgtttggtaatagtggcaatttgaaccggcgtaactactgcagagcgtccctgattcttcaggttatttcgtatgtacttgtgatcttctttattttgattgtagtagttggtggtattagctattatggttattaaataagtatctgatgggcttttcggcaaggcagcagtgctttgctgaaaagctttttcgtttttttagaaattctttagaaatctattccggttctctttagctttaggagatagactatagtcaaggatgagaaaaagaggagaaaagcagttatggaaatgaatcatgtactggtcgttgaagacgacaaggaaatcagagaaggtgtggaaatatacctgaaaagtcagggatacgaagtatttcaggcggcagatgggattgaaggtctggaagtgatcgagaaagaggaaatccatcttgcaatcgtcgatattatgatgccgcggatggatggaatccgtatgacgatgaagcttcgggaaaaatatgattttccggtgatcatgctgtcggcaaaatcagaggaagtggataagatcatgggactgaatatcggggcagatgattatgtgacgaagccatttacaccgatggagcttctggcgagggtgaattcacagctcagaagataccggatgtttgcagagaagctaagagaccgtgaagaaaatcagaatatccatgtgatcggcggtctggagctgaatgaagctacggtggaggtatcggttgacggagagccggtgcgcctgacaccgattgagtacaaaatcctgcttctccttatgaagagtcctggaagagttttttcggcagaggaaatttacgagcgtgtatggaatgaaaaagcgatcaataccgatacgatcatggtccatatccggaatatctgtgaaaaaattgagagctgcccgaaagaaccaaaatatttaaaggtggtgtggggcgttgggtacaaaatcgaaaaacaggcataaactagggattgtcctgattttaggtgcaatcttacttgcgacggtgatcgtgttaggaaactataatactttttataagaatgcaaaaaaggagcaggacagtctgacacagaactaccggacgagtgagtcctttatgaagacatttatccgggactgctatgtattgtattccaaagaatccggaaacgaatataacgtaaagtttctggatgattattatccggaatttgatgagaaatttaaccggcagattgcatatataaattaccaggtgcaggatgcaaacggagaggtaatcgatggataccggtcgaatagagattcctgggaaaaagtgaaagataccgagcttgcagattatgctcttgggattaagatctcgtttgacaaaaacggtgaaatcaagattgatcaggtgatgggaacggaagtaaccaagcaggaagctgttctgaagatcctgacctcaaatctgccggaaaaaatatttgaatatgaagatgaaagtgagattgaaaatatttcgccaaaagacaggacctattatttcatgatgacggaagcaaagctgaatgcttatgttatgcgggtatatccgattacttcaatggtgggaaacgcggcggtttatacaatcttgacccttatattgttggtcgcacttctggcatggctgattccgatgaagaaagatctgcatacaggagatgaaaaaattttccatgtaccatttgaaattgcgatagcgactggtattactggaattagcctgattttcagctatcttggagaactgattatgcacgcgaaaggaaatgtgtggccaatcgattttctggtctggtttgttttctttgcagtcatgtactgggtatccggctgtgtacgccagatccggctttttggagtaaaggaatatgtgaaaaaaagagttctgctgatctggatctggagaagattcggaaacggaatccgaggtggtatccactggtgcaagaataagatcgaagcattttatcattctctggatcagttcgatttcaaggaaaagaataataagattattttgaaaatcgtgctgttcaatttcgcgatcctgctggtgatctgttcattctggtattacggaattgcaggactgattgtatattctgtaatcctgttcctgatcctgcaaaaatattttaatgatctccggaaaaaatatgcattgcttttggaggcaaccaataaaattgcagacggaaatctggatgtagagattgaaggtgatcttggtgtgttcagtccgttccgtaatgaaatccagaagatccagaccggatttaagaaagcggtaaaggaagaagtaaaaagccagcgtatgaaaacagaactgatcacaaacgtatcacatgatctgaaaacaccgctgactgcgatcataacctatgtgaatctgttgaaagacgagaaagatgaggaaaagcgaaaggattatattgatattctggaacgcaaatctatgcgtctgaaagtcctgatcgaagacctctttgagatcagcaaagcaagcagccagaatgtaaagctgaatttgatgaacgtggatatcgtcaatctgtttaaacaggtaaaatttgagctggaagacaagttcgaagaaaaaggtctggagttcaggaccactttcccggaagaaaaagtgattcttcgtctggacagtcagaagacctaccggatctttgagaatcttctgaataacattgtaaaatatgcacttccgggaacaagagtttatgtggaaatcgaaaagacggagaaagatgtatttatccgcctgaaaaatatttctgcaaccgagctcacattcaatccggaagaaattacagaacgcttcgtccgcggagatgagtcccgcaataccgaaggctccggtcttggccttgcaatcgtaaaaagcttcgtaggtctccagggtggaagcttccacatcgaaaccgaagcagacctcttcaaagccgaaatccgctgggctttgccgggagaagagacagtgaagcaggaagcataagaaaaataaatggtaccgaattcaattttttttacaactgaatctggtaccatttatttttctgatttgtctcacaacctacattattcaacttttttactttggaaatccgctggagtaatgaatttcataatcatccgtgataaagagtgcctctgcccacttgattccttcgatatatttcaatccatcatctaaccccatcgcaaagcaggttgtactaagtgcgtccgcttccgtagaagagtcacagacaatactcaccccaagcagattatttttataaggatacccggttttcggatctaagatatggtgataaatcttgtcgcccaccttaaaataccgctcataaataccggaagaaaccacagattgatccttgatctttacactggtgatcgcttctccattctgtgcaaacggcttctgaatcccgatattataatccgaaccgtccggtttgccgccaagagccagcacatttccgcccagattgatcagcgcatgggatacattctgctctttcagatatgctttcagctgatccgcaatatatccctttgcaattccgccaagatcaatagccgcctccggatccagaagctgaaccgtatttccatcaaccctcacattctcatatccgatatgacgtttcgcttcctgaatcgccgcatcatccggaacggtccccgtattattcttaaaatcccacaagtcactaagtggagcgatcgtaatatcaaactttccatctgccagacggctgtattccacgcctttctgaatcaaatccaccgtatcacccgaaagtgtcacaggctccccgtttgcatggttcagctcataaatctcgcttccttccgaagtccggctaaaccgcgcattataatccttgcatttcgccacacaagcatccagaacatcctctgaatccttatcataaaccgtaatcgtcaccaccgtatcaaacaccgtcaccgtccgcgacaccggctgcggcgaactcccagaacatccgcccagacaaaaagtcccaaacaaactcaaacaaataccaattccaaaacttcttattttcatcgcaaatctcctcaaaccataacctacagcattgtttttttcataaacttcctaaaaacgacataatgaaaatttacgaatctcaggtctgtgcaaccagccaatgcacagccgtgcaggactttcgcttccctcacggcgtccccattctcttcttccacaaaccgtcccattcgtcaattaccccattatacgttcccctatgaaaaaaatcaatcgaacacttgattgcattagataaaatgatgtgttagaataaacaaagaaaaaggagaaccctatgagccataaagaaaataagagccatgaggagaaagcatccggtttcaaaaagaatgatctgattcttgtcctccttgtatttgttgcggcaggcattttttttgcaggacatctattcacgagccagaaaagcgcaggcgttgtagaaatacagattgacgggaaagtggtagagacactggatctgcagaaagagcgtgcatttaagatcaacggaggaacgaacaccgtgcagatcgagaacggaaaagtgaaaatggcagcggccaactgtccggatcagatctgtgtacaccagaaagcaatttcaaggaacggagagagtattatctgccttccgaataagatcgttctgaaaattgtcgatggagaagaagccgaactggatgcggtgacgaattaagatatgaagaaaaatacagtcagaatagcgtggtttggtgtatttactgcccttgcgctgatatttagttatgtagagactctgatcccgtttcagatcgggattccgggggttaagcttggactggcgaatctgatcgttgtggtggcactgtacaagatgggtggaaaggatgccctgttgctttcggtgacgcgtatcgtgctgtccggatttatttttgccagtctgtttagtattttatacagtctggcaggcggacttttaagccttgcagtgatggtgattttgaaaaagcggggatcattcagtgtttttggagtcagcatggcaggtggtgtctttcacaatgtcggtcagctgatcgtagcgatgctggtcgtggagacattcagcgtcgcctattatgtgccggtacttctgatcgcaggagtaatcaccggatttattatcggagttgtggcaaatgaaatgctcaaaagacttggcagcatcgtattgtcatagcatgggaggaagagatgatttcatatataagaggggagcttgtagctctcgaagaagataaagtgatcgtagatgtaggcggcgtgggctacgggatttttatgtccggacaggcgatgggacagcttccgccggttgggagtaaagtgaagatccacacctatctgaatgtcaaagaagatgccatgcagctgtatggatttctaaaccgtgatgcgctttctgtgttcaagcttctgatcggtgtcagtgggatcggaccgaaaggaggtcttgggattctggcgcagcttacaccggacgaacttcgatttgccgtgatgtcgaaggacatcaaggcaatttcagcagcaccgggaattggcaagaagacggcggagaagctgatcgtggaactgaaggataagctgaagattgaggacgtactggagcaccaggtggaagcggcaaatggagccgctgaagatacggtaaatgcacaaggacttcaggcagatgcggtacaggcacttacggcgcttggctatggaagtactgaggcactgcaggcagtacgaaaagtggaaatggatgagagcacgacggtggaagatctgctgaagggtgcactcaaatatttgatataagaggattaggatgggaagaagaattattaccacagagaatctggaagaggatgtaaaaattgagagccatttaagacctcagcttctggaagattatattggacaggcgaaggcaaaagagactcttaagatttatatagaagcggcaaaaagcaggggagaggcactggatcatgtgctgttttacggtcctccgggacttggaaagacaaccctcgccgggatcattgcgaatgaaatgggcgtaaatatcaagatcacgtcaggtcctgcgatcgagaaacctggggaaatggcggcaatccttaataatctccaggaaggagatgtgctttttgtagatgagatccaccggctgaaccggcaggtggaggaagtactttatccggcgatggaagattttgcaatcgatattatgatcggaaaaggggcttcggcaaggtcgatccgtctggatctgccgcattttacactggtaggggcaactacccgtgccggaatgctgacagctccgctccgggatcgtttcggggttgtgaaccgtctggaattttatacggaaaaagaactgcagaccatcatcatccgttcagcaggcgtgctggatgtggagatcgatgaaaagggagcccttgagatggcaagacgttccagaggaacgccaaggcttgccaaccggcttttgaaaagagtccgggattttgcccaggtcaaatacgagggggtgatcaccgaagaggtggcaaggcaggcactggatcttctggatgtggaccggcttggacttgatcatgtagaccgtaatcttttgacgaccatgattgaaaaatttcagggaggtccggtaggactggatacccttgcggcagcgatcggggaagatgccggaaccgtagaagatgtctatgagccatatcttctgaagaatggctttttacagagaacaccaagaggaagggtggtcacagatcttgcgtatacccatcttggatttgacaagaacgaagaatagaaaggaaagagacgatgctgaagataaaacaatatgtgaaagcagagagtctggagcaggcgtatgaactgaaccagaaaaagacgaaccggatcgtcggtggaatgctttggctgaaaatgagtactgcgcagatccagactgcgatcgatctgtccggactcggactggatcagattgaagagacggaggatgcatggaagattggatgtatggtatcccttcgtgatctggagttacacgaaggattaaatgaattgagctgcaacatgatcagagaaagtgtgagaagtattgtcggtgtacagttccggaatcttgcgacgatcggcggaagtattttcggacggtttggattttcggatgtactgacctgtttccttgcactggatacagaagtagaactttataaaggtgggatcatttctctggaagagtttgcaaagatggagagagataatgatatccttgtccgtgtgatcgtaaagaaaacaccaggaaagggaaactatcagtcacaccgtaataccaagacggattttccggtactggcggttgctgctgaccgttatggagatgaactgaaggtggcagttggggcaagaccgatgaaagcagtctgtattcacgttccggcagaacagctggatgcgtgcacagatctgaaaaaatttgcaaaagagcttgcagcccaggtgccgatgggaagcaatatgcgtggaagtgcagcgtatcgtacccatcttgcagagactctgatccgcagagcgttagagagaatcacaaacggaggtgaaaagaatgcagattagtctgacactgaatggaaaaaagattacagaagagatcgcagctgatctgcttctgatcgatttcgtgagaaatcatggatgttacagcgtaaagcgcggctgtgagacttccaactgtggactttgtaccgtatttttagatgagaagccggtactttcctgttccgtgcttgctgcaagagcagacgggcacaaggtagatacgctggaaggactgcaggaggaagcagaagaatttggctcttttatcgcaggacagggagcggagcagtgcggattctgtaatccgggtatgatcatgaatgcaatcgcactttttcgcgagaatccggatccaagtgatgacgagatccgggaataccttgcggggaatctctgccgctgttcaggctacgagggacagctcagaggaatccatgattttctggagtacaaaagaaaaggaggagccagatgaaagcagtaggggtaccatttgtaaaaaaagatgcgaaagcactggtgactggaaagccggtatatacaaatgatctggcaccaaaggattgtctgatcgttaagcttctaagaagtccgcatgccaatgcgatgatccaggagatcaagacagatgtggcaatgcgtgtgccgggaatcgaagcaatctatacctggaaggatgtaccgcagcagcgttttacaattgcaggacagacctggccggagcctagtccgtatgaccggctgatcctggaccagcatgttcgctttgtaggagatccggtagcgatcattgccggagaaaatgaagcctgcgtagaatgtgcaatgaagatgatcaaggtcaaatacgaggtccttccggcagtattagatcctgaggaagcgctggatggtccaattctggtgcatccggaggacagctggaaggcattgtgcccggtaggagcagataacaagcggaatctttgtgcacaggcagaagatggacatggggatgtagagaaagttcttgcagaatgcgatgttgttgtagaacatacatatcatgtcaaagcggcacagcaggcaatgatggaaccatttcagacggtctgctttatggatatgtatggaagactgaatgtgatgagttctacgcagatcgtttaccatgtgcgccgtattgtttccaatgcacttggcataccaaaatccaagatccgtgcgtttaaaccgaggatcggtggtggatttggggcaaaacagacggcggtaagtgaggtttatccggcgtttgtaacctggaaaaccggaaagccatcgaaaattgtatttacaagagaggaatcccagattgcatcctcaccgcgtcatgatatggcggtgacggttcgcatgggagcagataaagaaggaaatatccgggcaattgatctgtatacactttctaacacaggagcatacggggaacatggaccgacaacggtcggactttccggacataaggcgattccgctttatggttcattagatgcataccggttccgttacgatgtggtctataccaaccggatggcagcaggagcttatcgtggatatggagcgacgcagggaatctttgcggttgagacatctgttaacgaactggcagaaaaacttggcatggatccgatggagatccgtatgaagaatatggtcaaagaaggacagttcatgccggcatattatggggagacagcgaatagctgtgcacttgataaatgccttgcgagagtaaaagaaatgtccggatgggatgaaaagtatccaagaaaagttatgccggatggcaaaatccgcagcgtcggagtagcacttgccatgcagggatcctgcatttccaatgtagatgtcggatctgcaacgatcaaactgggcgaggatggtgtctacaatatgtcaatcgcggcagcggacatgggaaccgggtgtgatacgattcttgcacagatggcagcagaatgtctggactgtgatctggatgatattgcggtatccggagcagataccgatacttcgccgtatgattcaggctcttatgcatcaagtacgacttatgtgaccggtatggcggtgacaagagccggtgaggaactgaaaaagcggatcgtcagacaggcagcgaagatgctgaaatgtgaagtggatgaggttgatttcgatggacacattgcaagaagcgataagaccggagaagaggtgacacttgcggcaatcggagcaggggcaatgtgcggaagtgatattgcgcttcaggtaacagaaagccacagttcgccggtatctccgccgccttatatggcaggcgctgttgaaatcgaattggatccggagacaggacatgtcgagatcctggattactatgcagtggttgactgcggaactgttattaacccgaatcttgcgagggtacaggcggaaggcggaatcgtgcaaggaatcggcatgactctttatgagaatattcagtacacggaaaaaggacagcttctgaacaattcatttatgcagtacaagattccgacccgaatggatatgggaaatctgcatgtggaatttgagagcagctatgagccgaccggaccgtttggtgcaaaatcgattggcgaaatcgtcatcaatacaccggctccggcattgacgcatgcaatcgcaaatgcaacaggtctgtggttccgtgaacttccgattacaagtgaacagattgcaatgggaattatggaaaatgaaaattaaactgatttatctggcggctggaaacagccgccgttttaacagccaaaggatgcaaaatacagaaccgccacaatcagaagcagagaacaaactgctttatttgttggatgaaaagccgatgttccgctatttattcgaccgtctggtaaaagtctgtcaaaggcatccggaatgggaaatgattgtggtaacacagtatccggagattgagcatcaggtaaaagcacttcaggaaaacgagcagcaaggtgaacgtttcccggtaaaaacagtgatttcaaaagacagctataaaggagcagcctattcggtaaaagcagggatccgtgcggcaggagatgctgatgcctatgcattttttgtggcggatcagccttattttacagaagaaagcgtggaaggattcctggaaaagatggagcgggaggcaaaagttgtaccgggatgtgtgacctggaatggacaggaaggcaatccggtctggtttccggcaaagtacgggaaagagcttctggaactggaaggagatgccggaggaagaaaggtgttccgcagataccgggaaaaagcagtattttacgaggtgagcctggaaaaagagttggaagatattgattatatgccggaaatagaaaaaatgcggataacagaaggaggcacagagaaaactttccatgtatatgtcatcgaaaatggaaagcttcaaaggaaagagtctctgcttatggcacttggacttacggagcagatggtaccgagaattgctgccgtgggcgcgggaggtaagacttctcttttgaaacagctgcttgctgaataccaagagaagggtgccctcccggttctggtgactacaacccatatgaaaaaagagactgccccttattttgtaatggaggattctatcggaaaaattctggaagtgcataaaagagaaggcatggtgatcgccggtctggatgcaggaggaggcaggatcaaaagcctttctgtaccggtaatggaaaagatctgggagcttcctgcgccggttcttgtggaagcggatggtgcacggatgcttccggcgaaagtgccgggggagaaagaaccggttattccaaagcagatccagatagtcctttctgtatatggactcgatgccatcggacaaaggataaaagactgctgtttccgacctgagcttgtggcacaggtacttggaaaagcagtggaagaggttctgacggaggaggatctggcagggttggctgtttcggcaaaaggcgggaaaaagaatgtcctgccggaaatggatttctatattgtgctaaacaaagcagatgatgaaaaacgtctgaaaatggcagagagaatcgccttaagagtagaacgggattctggtgaaaaagtacggattacatcgtttcgttaatattttggaaaaataaagcaattgtgtgttgaaaaatggaacattgccgaattgtcattgaaaaccattcgtgctatcatagatacgatagctttgacaacgaaagttgtaagtgggtagagaaggaggcaaaaaagtgagtacgaagaatagtaatacttcacaggaactatttaaccttaacggaaaaccatcctttggtcaggcacttccgctggcattccagcatgtagtggcgatgatcattggctgtgttgcaccggcgatcattcttgccggtgtgtccggactttcagaatcagacacggttgtcctgattcaggcatctcttgcaatgtcagcgatttcgacattcatccagctttttccgtttatcaaatttaagtcttatcagataggagccgggcttccggttattatgggaatcagctttgcgtatgtgccgatcatgcagtcaattgcacaggatgcagatgttggaacaatacttggtgcacagatcgtgggcggtattgttgcgattattgtaggaatatttatcaagcagatccgtcatcttttcccgccgctggttacgggaacggttgtatttgcaatcggactttcgctgtatccgaccgcagtcaattatatggcaggtggagcaggaagtgcggattatggttcatggcagaactggcttgttgcgatcatcacactggcagtcgtaacaggactgaatcattttggaaagggctttttaaagctttcttccgttttgatcggaatcatagttggatatgtagttgcgcttggctttggaatggtggatttttcttccgtattaacggcaaaatgggtacagttcccacagccgatgcatttcggaattaaattcgagccatcctcatgtgttgcgattgcggtattgttcgcaatcagctctattcaggcaatcggagacttttcagcaacgacgaccggaggaatggaccgtatgccgacggatgaggaattaagcggtggtatcattggttatggagtcagcaatattgtctgcgcatttttcagcggacttccgacagcaacctacagtcagaatgtcggaatcgtaagttctacgaaagtagtagcaaagagagtatttggaattgcagcgatgatcatgctggttgcaggaatcatgccaaagatcgcatacattcttctgactattccgtcatgtgtgcttggaggcgcaacaatctctgtatttgcaatgatttccatgacgggtatcaaactgatcaataattcaaagatgaattatagaaatacatccatcgtaggacttgccattgcacttggaatgggtgtgacacaggcaaatgcagcacttgcgcagctccctgcatgggtaacaaccattttcggtaaatcaccggttgcactgtctactctggttgcagtgttcctgaatctggttttaccaaaggagaaagaagagtaaatgaagatcctgataagaggagccggggatcttgccacaggaattgcggcagagctgtgggaaagaggacatcagatcctgatgacggatgttgccatcccactcaccgtcagacgtgaggtggcattttcaagagcggtgtacgaagaacatgcagtggtagaaggaatggaagcagttcttgccgaaaattttgaagaagcagaaacaattatggcaacgcggaaaattgctgtcatggtggatgaaaaagcagaagtgcggaaagaatatctgccggatgtactggttgacgggatcatggcaaaaaagaatcttgggacccggatcagtgacgctcctcttgttatcggtatcggaccgggctttacggcagccggagactgccattttgtgattgaaacgcaaagaggtgagcatctgggcgaggtgatccgcgagggaagtgcaatccccaacaccggaattccgggaaatattggcggctatacggtggaacgccttttaaaggcatccgcagacggaatcatgcatccggtcgcgagaattggtgatgtggtgaaaaaagggcagattgttgcaaggtgcggagatgaacctgtctatgcgagactccacgggattgtccgtgggatgctccaggaaggtgtaccggtcaaaaaaggattgaagatcggagatgtagatgcaaggatagaggaaaaactttgttatacgatttcggataaagcacgaaagatcggaaacggagttgcggaagcaatcgattttgcctataaaacaaaataaaaagttgtccgaacaacttatttatccatcctttttatggtagaatataaaaaggtttgggcagaatacctgccgcagtgacggcaggtatttttatgccataatccatataaagtgaggaacaaaaaatgaaactggtaagaacagaagatgcagtggggcaggtgctgtgccatgacattacacagattattccgggagttgtaaaggatgctgttttccggaagggacatattgttaccgaagaagacattccggtacttttatctgtgggaaaagagaatctttatatctgggaaaaacaggaaggtatgcttcatgaaaatgaggcagctgagattttgcgtcaaatctgtcagggtgagcatatgcatccttccggggtgaaggaaggaaagatcgaactgatcgccgactgtgaaggggtattgaagatcaataccgaaaagttgaatgcggtgaacagtcttggtgagatgatgatcgcatccagacatggaaattttccggtgaaaaccggagataagattgcaggaacaaggatcattccgcttgtgatcgaagaagaaaagatgcagaaggcctgtgaagtggcaggaaaagaaccgattttccggattcttccgtaccagaagaaaaaagcgggaatcgtaacgacgggaagcgaagtgtattatcaccggatcgaggataaatttactccggttgtgatcgaaaaactgaaagaatgtggcgttacagaggtgaagcagatccagtgcaacgatgatcatgagatgatcacggaagcaatccagactctgatcgaggatggttctgacctgatcgtctgtaccggtggaatgagtgtagatccggatgacaggactccgcttgcgatcaaaaatgcctgtacggaagtggtgacttatggggcaccggttcttccgggagccatgtttatgcttgcttattgtgaaaaagaaggcagacagattccggtcatgggtcttccgggatgcgtgatgtatgcaaaacggacgatttttgatctggttcttccgaggattatgtgtgatgaaaagctgcatgaaaaagatttccggcttcttggacagggaggactttgtctgtcctgtccggtgtgtacttttccaaactgtggatttggaaaaggaggatattaaaatcatgagaaagaataacttatttaagaaaacagtggcagcaggtctggttctgctgatgacagcatcacttgctgcatgtgacggtaaaaagaccgacacaaaaacagaagacaaaaagacagaaacaaaggctgacaaagaagaggatgtagagcttcaggtatttatcgcagccagcctgaatacggcaatgacagatattgcagagcgttatgaaaaagagcatccgaatgtgaagattgtctacaatgcagacagctcaggaactctgctgacacagatcgaagaaggatatgagtgtgacctgttcttctctgcagcacagaaacagatggatcagcttgaggctgacggactggtagtagaaggaacatgccataatgtagtgaacaatcaggtagttgttatcacattaaaggacagtgatacagcagtaaccgggcttgaaaacttaaatgaggcaaagagcattgcacttgcaggcggaagtgtaccagttggaaaatacacccgtcaggcgttgatgaatctcggaattctggacaaagtagacgatgcgtctaccatcacaacagaacagatttctgaagctcttggtggaatagagatcagtgagcaggcaaatgtaagcaaggtgctgatcgccgttacagagggtgcatgcgaagttggaacaacttattattctgatacatacggatatgaggatcagatcaagatccttcagacagtaagctatgatctgacaggtaacgtggtttatccgatctgccgtgtggaaaataaagaggcagatgatgcaaagaaaaaagcagccgatgatttccttgcatatgtaacatccgatgacgcaaagaagatctttgacagctactatttcgatacaaacgtagagtaaaagaggaacgatatggaagaaataagacagatccttgcaggacttgactggagtccgctttttatttcaattaaaacaggaatcgcagcaacgatcgtgtcattcttcctgggaatatgggcagcaagaaaggtgctgaaagcgaagacgggtctcagggctgtgctggatgggattctgacactgccgctggtgcttccgccgacggttgcaggatttttcctgctgctcattttcagtacgagaagaaccgttggatcgtatctttatacgacatttgatatcaagatcgtacagtcctgggcaggatgcgtgatcgcggcgactgtgattgcatttccactgatgtaccggaatgcaagagcagcatttgaacaggtggatgtgaacctgatctatgcggcgcagacgctcggtatgccggagtggaagattttctggagggtgatcatgccggcggcaggtcctggagttgcatccggtacaattcttgcatttgcaagagcgcttggagaatatggtgcgacctccatgcttgcgggcaatattccaggaaagacggcaaccatttcccagaggattgcaatggtcatccaggacggtgattatcagacggcaggcgtgtgggtcggaattgtaatcctgatcgcattcggaatagtagtacttatgaatctggcatttggaaagggaatgaaacatacaaagcaatggtagaactagagataaaaaaacagtatgaaaaattcaggctggatgttgcctttaaaagtgaaaaaaagtggatcggaatcctgggcgcttccggatgtgggaaaagcctgaccttgaaaagtattgccgggatcgaaagaccggaaaaagggcggatcgtgattgacggagttaccctttttgatgccggaaaaaagatttttctgaagccacaaaaaaggaaagtcggttatctttttcagaattatgcgttgtttccgaacatgaccgtggagcagaatatcgggattggatttaccggaaacaaagaagataagcagaaaatggtagaacagttgatccatcatttccagctggacggactggaaaagctttatccgtcaaagctttccggcggacagcagcagagaacggcactggcacggattatggcatatgaaccggatgtgatccttctggatgaaccattttcggcactggatgcgtatcttcgggagcggatgctgaccgagctgatggaaatgctgagtgattatgaaggtacggtgatcatggtgtcccacagcagggatgaaatctacagcttcagtgaagaggttctggtaattgaagatggacatggaatccgcctgggtccggtaaaagaagtatttaatgcaccgcgctataagacagcggcaagacttaccggatgtaaaaatattgcagatgtttaccggatggatgcgcagacggtgtatgtgaaagactgggatgtgcagctgattttcaaaggacgcagtgtgccggagaatgtgaaggcaatcgggatccgagctcatgatctgattccggtgtatggaacgatatccggggctatgctgaaagttaaagaatggaaaagtgtggattatccatttgaacgaaaatattttatccaatgcgagtcgggatgtgaggacttctgctggtttgtccaaagagagatttctgccactctggaagaaaaaggaatgccggatgcactcgcatttccggaagaaaaagtgctgttccttgaaggatagcgtggcagatgctataatggacaaatagagaaaacgggcagaaggtggcagcataaatgcagaaagaacaagacagggaagcgatttaccggagcattttcttctgtgatatggatcggaagaaggcggatgagatcattaaccggttagacggcagaaccgtaacctatgacaagggcgaaatcatcataagagaaagagaaaaactgaacaatatcggaatcctgcttgacggggtactctgtaaagtgcagtattaccgggatggaaccgaacagctggtccagaagcttgtcagctcgtttgttgtgggagtggagattgcggtcagtgaaaaaaagacgagtccttatgatgtttatgcatcggaacaggcacacattttctggtttcctgtacgggcgatggaagaagagggcgttctggatctgcgtgagaggattgagttttacaagaaaacggttcatttccttgcaaatgaagatatccgcaagtgcaggaagattgaattgctgtcgatcagaggaatccgggaaagaatcgagcagtatctgagaattcagcaaagccgccataaaagcaatgcctttgatattgaatttaacagagaacagatggcaaattatctggggatcaaccggagtgtgctgtcacatgagttgaaaaaaatggaaaaagaagggattttgaaggtcagaaagaatcattttgagctggctgataaagaataaaacagaatttctgctgaaaatatcgaaaagtggttggtttttatcagaatatagtttataatgaaaaaaggattaggcggcaaggaggttctttatggcatcgtcaaaaaattatacagaagttttgataggcggcaaagtattcaccctgagcggatttgaaagcgaagattatctgcagaaggtatccacttatctgaaccataaaatcgaggaatgtacaagcagcgatggatatcgcaagcagagtgcggaagccagaagtgtgcttcttgctttaaatatagcagatgattattttaaagccaagaaacagggcggcgcattagaaagcgacatcgaggaaaaagacaaagagatgtacgatttaaagcatgaactgatctcagtacagatcaagtatgagaatgctgaaaaagcactggataaactcaaggcagagaaccaggaacttcagatgaagatcgtacagcttgaaacagaaatgaaaaatcaccgtacaaaatagactgtcctgaggcagtctatttttgatactccggtatacaaagagaaatgtctgcaacacaggggctttgtatacaggttatttaaagatagaggagttatatgaaagacagagttgaaatccttgcacctgcagggagtatggagtgcctgaaagcggcaattgcagcaggagctgatgcggtatatacagggggagcccttttcggggcacgtgcttatgcacataacctgacagaggaagaacttttagaggcaattgattatgtgcatttgcatggaagaagactgtatctgaccgtgaatacactgatcaaagaccgtgagatggaaaaacagatgtatgattacctgctcccttattaccggcaggggctggatgcggtgatcgtgcaggatattggactgttccgttttatccggaagcattttccagatcttccgatccacgcaagtacccagatgacgcttacgggagtggagggggcgaagtttctggaaaaggaaggtgcacagcggattgttacatccagagaactgagtatggcagaggtgaagaagattgccgatgagacagagctcgagattgaaagctttgtacatggtgcactctgctattgctattccggtcagtgcctgttcagcagttttatcggcggcagaagtggcaaccgtggacagtgcgcacagccgtgcagactgctttaccggacaccggaagcaaagagaccgcagtatctgctgagtcttaaggatatctgtacattggaactgatcccggagatgatcgagagcgggatttattctttcaagattgaaggccggatgaagaagccggagtatgcggcagcagtcgctttccagtaccggaaatatgccgatctttatctgaaatattacgaagaatgtccggcagaagaggatccggcagcgtatgcgatgaagaaataccgtgtccgcgaggaggatcggcagatgctgctggatctctataaccgtggcggtttccatacgggttattatcatacacagaatggacgggagatgatttccttaaaccgtccgaaccatgcaggagtgccggcagtaaaggtacttgctaaaaaaggcagaaatgtgactgcaaaagcactgacagacctgtatccgcaggatattattgaactcccgatgcgcaaaggcagggaaaaagcagataattatacctgcaaggatgcagtcagaaaaggaatgaatgtgcagatcccggtatttgcagataccccgttcaagagggatgaaatctggatgcgtacaagaaacagcacattgattgacacgctgcgtgaagaatttgtaaatggaaaaataaaagaacggatctgcggaactttccggctgtatccgcaggaaaaggcaacgcttacggtgaagtgccgggatgccgagattacggttgccggtgaaaaagcacaggaagcactgagccagccgatgagtagagagcggattgaaaagcagctgcgcaagacgggaaatacggaatttgaattttcctttttaaaggccgagattggagaaaaagtatttcttccgatgcagagcctgaacgaacttcgaagggaagcactggagacactggaaaaagtgatctgtgagaaatacagaagaagtggtgaagtgaaagatccggaagaagataagacagagctttcaatggaagaagaggtactttccggatggacggcatcggtaagaaccgcagaacagatggaagtgattctggaagaagaagcaatcggaagaatctatgtggattgtaccatgttccctcgcatctgggagaaggacagctatgtggagtggattacaaaagtacatgcagcagggaaagaaatttatctggtcatgccgtatattttccgggaaagaacccgaaaacagtatgaagctgcatataaccggatattcggagccggatgggacggcattctgatcgccaattatgaaagttttgcgtttctgaaagagcatggttataccggaaggattatgaccgattacaatctgtatgaatttaatcaggaaagcaggaaattctggaaggaaaagggagtttttgaatttacagcgcccgtggaactgacagaaagagaactccaggatctcagggtaaaggatggagaagtgatcgtatatggttatcttccgatgatgatatctgcaggatgtattcagaaaacgaccagaggatgtctgaaaaaatccggacagacgacaataactgacagatatcgtaatccatttgtggtaaaaaatgaatgtgattactgttataatatcctttacaattatgtaccattatatctgggagaccggatggaagaggtatatcagatcggtcctgggcggatccgactgatgtttactactgaaaggcagcaggaggtaaggcagattttaagtgcgtattttgaaggaaaagagcttccggagggaacgtacaccaggggacactggaaaagaggaataaagtaggtggaattttgatcaatataattgtagagctgtcaaaatatctgatgatagccctgatgctggtctatacatttgaatgttttgcagtatttaattacgcagatgagtatacacagagaagtattttcagaaagcagaatgtgctgatgtttctgcttcatatgattgcatttctggtgatgtatctgcagacaaatgaaacaaaaatgatcggattttacgggatgcaggtggtactgtttctggcggtcattttgctgtatacaataatttacccgcgggtgtcgcgactagttgtaaataatatgtgtatgctgatggcaatcggctttattatgatcaccagactttcgtattcgcttgcggtaaagcagtttctcattgtcagtgcatctgtagcgataagtcttgtgatcccggtcatcatccggaaagtaaaagctctgtcggaatggaaaatattctatgcaattgcaggtgttgtaatgcttggggtcgttatcattgtaggacgtgtgactggaggagcgatgctgaatgttgcaatcggaggttttactcttcagccatctgagcttgtgaagatcatttttgtatttttcgttgcggcgagtctgaagactgatacttcatttaagaatattgtgatcacaacggcagtggcagcaatgcatgtgctgatcttggttgtatcaaaagaccttggtgcggcgttgatcatttttgctgtatatctggtgatgctctatgtggcaagcagacagccactttatgtacttgtcgggctgattgcaggaagtggggcatcagttgtggcatataaattatttaaccacgttcgtgtgcgtgtactggtatggaagaatccatttaccgtttacaatgaaggtggttatcaggtggcacaatccttgatggcgatcggcacaggaagctggtttggaatgggactttttcaaggggcggcagatcagatacctgttgcagagtcagattttattttttcggcaattacggaggaaatgggactgatttttgcactttgtctgatcctggtatgtgtcagtgtttatatgatgtttctgaatattgcgatgcagcttcgggacagcttttataaactggtggcactgggacttggaacctgttatatttttcagacatttctgacgatcggaggtgtgacaaagttcattccgtctaccggagtgacacttccgctggtaagctacggtggaacctccgtcctcagtacgatcattatgtttgcgatcattcagggactgtatgtattaagagaagacgaggaagaagacattgaaagaaaaaaattacagagaagacgaacttccagatctggatcagcagctggagagcctgccagacgagagcgggtatcacgaccaaaagaagaaggcagaaggaaaaagccgcagcagacgaacggatggcgaaccgaagaaaaaggccgaacgcagcagcctaaaaaacggacagcggcgtccgaaagaagcacaggcagaaagaagcggagccagtaagaaaaaagagaagcagatgaccaataaagaactgacgagagttacttatatttttgtaacactgtttttggtactgatgggatatctggtttattttaatgtggtaaaaagtaaagaggttgtcaacagcacgtacaatatccgtcaggatcttcttgcggaccgtgtgctgcgtggcagtattacagataaaaatggagaagtgcttgcacagactgtgacaaatgacgatggatcggaaacaagggaatatccggaaggagaagtgtttgcacatgttgtcggatatgccgcaaaaggaaaatccggactggaatcctcacagaatttcaatcttctgacttcaaatgcctttttcctggaaaagctggcgaatgaatttaaagaccagaagaatacgggagatacggtggtcacaaccttggatgcgaacctgcagaatgcagcatataatgcactgggagataacaaaggtgcagttgtcgtgatggagccaagtacagggaagattctggcaatggtatcgaagccgtcttttgatccgaataatgtttcggaaaactgggatgcactgaacaatgacgagaacagttcgcttcttaacagggctacacttggacagtatacaccggggtcgacatttaagctggtgacaacacttgcttttatgcggcagaatccagattataacaattattcgtttgaatgtaacggagaattctcacagaatggggtaacgatccactgttataacagcactgcccatggggaagagaatctgacggattcggttgcaaattcctgcaattcttcgttttcaaatatcgggctgcagctggataaggcagaatggagaaagactgccaaacagatgctgtttaacagcaagcttccgggtgatgtgaaatataatgaaagcagtttccgcctgaaaacagatgcaggagatgcggatacgatgatgactgcaattggtcagggagagacacaggtcagtccgtaccatatggcgatgatcgtttcgacgatcgcaaatggtggaaagctgatgaagccgtatctggtggacaagattacaaattatgcaggcacaacggtgaagaaatatatgccggaaagctacaaagagttgatgacatcatctgaagctgcacagcttacggaatacatgaaggcggttgtggattatggtaccggagctgcgctttcaggtgcgtcttatacagtggcaggaaaaaccggaactgccgaggtcagtgaagatggaaatacagtacattcctggtttgtcggattttccaatgtggataatccggagctggcgatcagtgtctgtgtcgaggatgcggatacggcgaccattactggtgtcagtgtcgcaaagcaggtgtttgattcttactataataattaaaggtcaaggtgacagcgcacatgaggttttacaaaaatctttatgtcagcgagagcatgacaaaaaagaaagaaaaagtgattgcaaaactgaataaaaaaaagtatccgttgaatacttatgtgatcgcgctgattgaagaaggggaaaatcagctggaattttattcgacgttgatgttccgacagggaagtgtgatcgatgatgatattttcgttgtcggcatagcgggtggatatgatgatgcgctgtatctggtagaagagattgcgaaggaagtttatgaaaaaacaggggatctggatatccggtcctacatcagagagcgggagagggaagaagcatgattctacatatcattggattgattttgaagattatcgggattcttcttctggtgattcttggaatcctgctacttgtgatcggtgtccttctctttgtaccgctgaggtatgaactgcgtgccgagtttccggggaagctggaagatgcagaggggaatcttaagatttcatggctgcttcatctgattgcaggaagagtggagtatcggaacggagatgtgaaatggcaggggcggattgcctggaagaagttgggagatgttctggaagcggaagataaaccggtgagaaagaaggagaaaaagccggatggcggaaaaaaagccggtgcggagaaggccagtgagagaacggcagaaagaaatgatgcggcagatgtaaagaagccgcagacgctgccggaaaagagagccgaaagcggaacgtatgcaaagccagagcatacggacgtgaaagatgagaagtccaaaacagaaacacagggaagtcctgacacgaaggtgaaaacattttcagaaaaaaaagaagagaatgctacaccggaaaaggaaagtgaatccagagaaaaaaaggatgttcatggcgagagaggattcggaaaggctcacaaaactccacgaaagcggaagaaaccagtcaaagcatttggaaaactgatccggaagctcagtcagaagcttcgtgagatcctggaaaagatcaaatgtacatggaagaatttatgtgataaaataaaaaatatcgcagataaaaaagataaaattctggagttcctggaacaggaaaatcataaagcagcttttgcacgtggcaaaaaggaactggtctgggtgaagcgttttctgaagccgaaaaagcttcgcgtaaaactgcatttcggttttgaagatccttaccataccggacaggtactggcactttgtggaatgttttatgcatttatcggagaaaatatggatctggaaccggattttgaaaagcgggtactggaaggttccgtttatgtaaaaggaagactaagaacagttcatatggcagtatttgcagcaaagatgctgctggataagaatatccgcagcacttaccatgatatcagggagtttaaatggtaaagctttcgatagaaaataacaggaggaatcgaaaaaatggcagtagataatcagtttaaagagacagtagatgcattgtttaaagggatgaacggcgtggtatcatccaaaaccgttgtaggagatgcaatccacatcggagatacgatcattcttccgcttgttgatgtatcttttgcaatcggagcaggggcatttcatgcggacaaaaaggacagaggagccggcggactcggcggaaagatgatcccgagtgcggtgcttgtgatccagaacggaacaaccagactggtcaacatcaagaatcaggataccatgaccaagatcctggatatggtcccggatgtgatcgaccgttttaaatccccttctgaggataagatgacggaggaggatgtggcagatctgttaaatgaagcagattctccggaaaatcaggaatagacgtaggtttctggcatatatttattgtaaaagaggaaaaagcaggaacgaagatgaaacgggtatttggttttgcactgttttttgtggcactgggtatggtgatcatgatgtttattccgagcatatttatcggaattctgatcgttctgctgtgcctccttgtcggatatcagcttttttgctgttgattttgaaaaaatatgagaacctgcaggggaaaccctgaaaaaagccttgcgtatgcaggacttttgtgatacaatgctaacgttgcaaaaaaacacgtgtgtggtttatcccggtggtgccaaagctgacaagcatggttcgcggacataagcacacggaagtaaaaaaccaatggaggaaagaaacatgagcgttatttcaatgaaacaacttttagaagcaggtgttcatttcggacatcagacaagaagatggaaccctaagatggcagagtacatctacacagaaagaaatggtatctacatcatcgaccttcagaaatctgtaggtaaagtagatgaagcttaccaggcagtatctgacatcgcagcagaaggtggaaagatccttttcgtaggaacaaagaaacaggctcaggacgctatcaagacagaagcagaacgttgcggaatgtactatgttaacgaaagatggcttggaggaatgcttacaaacttcaagacaatccagagcagaatcgctcgtctgaaagaaatcgaagctatgtcagaagacggaacattcgatgtactgccgaagaaagaagttatcgaaatcaagaaagaatgggaaaagcttgaaaagaaccttggcggaatcaaagaaatgaagagaatcccggatgctatctttgtagtagatcctaagaaagaaagaatctgtgttcaggaagctcacacacttggaatcccgctgatcggtattgctgatacaaactgtgatccggaagaacttgattatgtaattccaggaaacgatgatgctatcagagctgtaaaacttatcgtatctaagatggctgatgctgtaatcgaagcaaaccagggcgaagcagaagaagtttacgaaggcgaagacgtagaaacagctgaagaaacaacagaagaataattcgaacaatccaaaagatcatattgaaagatggaggaaaaaatcatggcaatcacagcaagcatggtaaaagaattaagagaaatgacaggcgctggtatgatggactgcaaaaaagctctgaacgaatctaacggagatatggatgcagcaatcgaatacctcagaaagaacggcgaagctaaggctgttaagaaagccggacgtatcgcagctgaaggtattgttatggcagacgttaaagaagataagacagcagctatcgtagaagttaactctgagacagacttcgttgctaagaacgctgatttccaggcattcgtaaaagcagttgttaatcaggcacttactacaaaagctacagatatggaaggattcatggctgaagcttggaacgaagatgcttctaagacagttaacgatgcacttacagaaaagatttctgtaatcggagaaaagctcagcatcagaagattcgaaaaggtcgttacagatggctgtgtagtttcttacattcacggtggcggacgtatcggtgttcttgtagaagctgatacagcagttgttaacgatgctgttaaagaagctctgaaaaacgtagctatgcaggtagcagctttaaatgctaagtatgtaagccaggcagatgtagatgctgattacatcgcacatgagaaagaaattcttcttgctcagatcatgaacgacccgaaagaatctcagaaaccggaaaaggttatccagggaatgatttccggacgtatcaacaaagagatgaaggaaatctgtctgttagatcaggtatatgtaaaagctgaagacggaaaacagtctgtagctaaataccttgatgaagttggaaaagctaacggaacaactatcactctgaagaaattcgttcgtttcgagacaggtgaaggtcttgaaaagaaaaatgaagatttcgcagctgaagttgcagctcagatgggaaactaatttatcaatcgcaagactggtaaaaagcaaattaaatagcgtatttaagcggtttctgcctattttgacaagtgttatgaactactgtaaaatctcacaaaatatcgtgctattttgggtacagattgggtagggtattgggtaaagaaatttacccaacctcttaacgaggaatttacttgttgtttaaaaatagaaagggaacgctgtgagtgttgagggtgtattgcattttgcaatatgccctcaaattttttaaaaaaataatgttaaagattggggaatatggtcctatgtcaagatttagtacaagttaaaatgaggttttccccattttaacctgccatcagcaattcgtgttgttcccttcttctgttatctgatttatagaaacttattaacctagtagtcttgattgactacatcattattatactaggagagattattatgaaaaaaataacagcacttgcacttacttcagcaatggtattatcccttgcagcatgcggaggttcatcttccgatacaaaaacttcagatgattcaaaaaaagcatccaaaagcgatgtagaatacgttcaggacaaaggaaccctggtagttggaatcactgattttgaaccaatggattacaaagatgataacgatgaatggatcggttttgatgctgatatggcaaaagcatttgcaaaaagtcttggcgttgatgctgaatttgtcgagatcgactgggacaataaagtcatggagctggatggaaaaaccatcgactgcgtatggaatggtatgacacttactgatgaagtaaccagcgcaatggcatgcacctccgcttactgtaacaatgcgcaggtagtggttgttccttctgataaagcagacaaatatcaggacaaagacagtctgaaggatctttcttttgcagttgaatccggaagtgccggagaagaagctgtaagcggagaaggatatgactacactgcggtttcttcacagtctgatgccctgatggaagttgcagccggaacctctgatgctgcagtcatcgaccttctgatggccggtgctatggtcggaaaaggtaccggatacgaaaatctgactcataccgttgagcttactaccgaaaaatatggtgttggattccgcaaaggttccgaccttgcagacaaactgaacgaattcttcaagacaagctacaatgatggttctatgaagaaatgcgctgaaacctatggggttcaggatgccatcattgagcagaaataatatttaaggcaggaactttttatggatctgattatgaaacaaatgccggtcgtagtgtccgcactgaatgtcggctttttacaaactttaaaattatttattgtgacgctggtcggtgcccttcctctcggactggtcattgcctttggttccatgtctcattttaagcctcttagctggcttgcgagactgatcgtctgggtgatccgtggtacccctctgatgatccagcttctgatcatctactatttccccggtctggtcttacataacccgatctggggtggtggtgaagcagggcgcttccttgcagcagccgtatcttttatcatcaattacgcctgttatttttcagaaatctaccgcggtggaatccagggtgttccggaaggtcagaaagaagccggtcttgtacttggcatgacaaagcatcagatctttttcaagatcacactccttcagatgatcaaacgcatcgtaccaccgatgtcaaatgagatcatcaccctggtaaaagatacttctcttgcacgtattatcgcgctgcaggagatcatctgggcaggacaggcatttatgaaaggctcacatggcatctccggtgctatctggccgctgttctttaccgctgtttattatcttattttcaatggtatcctgaccgttcttctcggacgccttgaaaagaaactggaatatttcagataaggagaattcatatttatgccaatcttagaagtagaacatatcagtaaatcttttaataagactcctgtcttaaaagacgttggatttaacctggaaaaaggacaggctgtttccatcatcggatcttccggaagtggaaagacaacgcttctccgctgcctgaactttctggaacatccggataacggaattatccgggtaaatggcgaaacactttttgatgcctctgtcccggcaaccactcaggaatccgtgatccgtaaaaaacgactgcattttggtctggtattccagaactttaatctgtttccgcagtataccgctctggaaaatgtaatgcttgccaaaaagcttctcgccgcagagcagccggattttaaagaaagaaaacgtgaaatcctgaccgccatcgaggtacaggcgaaggttcttctgacacagatggggttggataaccggatggacaattatccgcatcagctttccggcggacaatgccagcgagttgctattgcaagggcacttgccctgcaaccggacatcctctgttttgatgagccgacttctgcactggatccggaactgaccggagaagtattaaaagttatccgcgagcttgccgaccagaatacgacgatgatcattgtaacccatgagatggcatttgcacgcgacgttgccgatcatgtgatctttatggacgacggacgcatcgttgaacagggtgatccgcgtcaggtgtttgaaaatccaagtgaagagagaacaaaacagtttctttcgcggtttcatgaaggataagctgttagatgaagaagaggacttgtaaggttttagtcttacaagtcctcttgaaattttatctattacatttttccatttgtggatagcattctttcgcaaactttttgttatcccaatagcatggtttttgaggtgtcttataaagatcgcattcactacatctgtttattgtctttttgtccttttcctaacttcacctgctttcccattttcattgactttccctctgccgcaccttatacttaaaagtaatgacttaagaaacgggggaaatattctatgtcaaaatcttcagccaaactgatgacagaaggctccatctggaagcgtatcgttgcttttgcgatcccgcttttctggggaaacctttttcagcagctatataacaccgccgactctctgatcgttggaaattttcttggaagctctgcacttgccgctgtcagctcttccggtaatctgatctttcttatggtcggtctttttaatggaatcgccatcggatccggtgtcatcgtcgccaaatattacggtgccagagacattccgaatctgcagaagtccatccatacaaccgttggcttcggactgatctgcggcgtgatccttaccattgtcggtatcattgccgcaccacagatcctggtgcttatgggaacaccggaggcggtacttccaaactcgattacttatttccggatctactttaccggctcacttgcctttgtcatgtacaacttctttgtcggcattctgcagtccgtcggtgacagtacccatcctctgatctacttaatcgtttcttcggtaacgaatatcattcttgaccttgtactgatcgcaggtcttggatttggagtaggtgctgccgcttttgcaactgtcatttcacagtttttaagtgctatcctctgtatggtgcagctgcttcacagtccggaggagtttcggcttcatctgaaccggatcaatctggattcctatatgctccgccagatcatttcttatggtctgcccgcaggactccagaactcgatcatttctctggcaaatgtattcgtccaggcaaatatcaaccagtttggggaaatggcggttgccggatgtggttcttatatgaagatccagggatttggattccttccgatcacctgttttgcactggcacttactacttttatcagtcagaatctgggtgcaaaagagtatgagcgtgctaaaaagggcgctgtattcggtgtgatctgttcccttacgatctctgagctgatcggtatctgcgtgcattttaccgctccacagcttctatctgctttcagttccaccgcagaggttatccgctacggagccatgcaggctcatacggatacctttttctacttcctgcttgctttttcacactgtatggcaggaatcatgcgcggagccggtaaatccacagtcccgatgtatgttatgctggtatgctggtgtctgatccgcgtttcttatatcgtgatcattttaaaattcatcccgtccattcagatgatcttctgggcttacccgatgacctgggcgctcagttccattgcttttctgatttatttcctaaagtcagactggatacacggactggaaagataaattccacaaatttatacttgactcatcgtatacaaaaaaccattacaggatctgatgaaatcacatctctcctgcaatggttttcttttatcctaacccacatacagtttctcactgctgtatccgttttatttccattatttatccattcatatttccgtttcgtcaagaatacggaaatgtttcctgtctacttcgatcagcctgtctttctgcatctttccaagctcatttgacatcgcggacctgtctacattcagataatctgcaagctgctgccggttaaacgggatatcaaattctttcttcccgttttccatagcctgataagacaaatacgacagcagtcttccccggatcgattttgatgaaatatgaaaaatccgtttcgacagacggagattcttctctgcggaaagcttcagcagattttcaattaacgtatgatgaaacacacacgaattggaacagactttcagtatccttcccacatcaagaaacaaaattcttgcctcttctgccgcaactacattgaccatcagcttctgcccaggaatcgctgcatatgtttctgcaaaaatctcgcctcttccagcccggtccagaatgctatgattcccccagatatcatcattctcaatgaacacgctgccggaaagaaccacgcccattgaagtaacctcatccccggcatggtaaatgatttcatcttttttataagtcttttctaccggattcagacagttcagcatctgtctggcgtcctccttcgtgacgccccggaaaattgctgcctcctcaaatatgcccattttctgctactcctcaattctcaatgcatttctgtccgctttttaaccaaatcaaacagcaaaacaaattacgaatatccacctgactttatttcccaaagttatttttttcgtttctttctctgatatattctgcttagtccatcctctgtctccttttgcaatcttgtttttatagcctttttcgtcttagtatgtgcccggattgctccattattatataattcatacttttgatgcttacatcatcttactatatttttgcaaaatcgacaaatctgtactgtttatctttgccagataaaacaacattctctatcgacattcattcaataagatttttaaactcaatcgtttccaacctatacaaaaaacggagaacaagatttttcaaggttgtacatgacttgaacaatcccgttctccggttaatatcttatgatttcctgttccctgacataacctcacatttgtcagattctgcgtctattctataaacatcgcatccccaaagctgaagaatcgatatctctctttaactgcttcttcatatgccgcaagcacatgctctcttccggcaagcgcacttaccagcatgatcagcgttgactccggtaaatggaagttcgtgatcaggcagtccagtaccttgaatttatagcccgggtagatgaaaatctctgtccatccactgcactcttttaactttccgttttcatcagccgcagattctacggtccggcagcttgtcgttccgacgcagatcacccggtgtccgctctcttttgcacggttgatcttttctgcctcagatgcctcgatccggtagaattccgaatgcatatggtgatccagaatatcatccgcttttaccggacggaaagttccaagtccgacatgaagcgttacatgcgcaatctccacaccttctgctttgatttcttccagaagctccggtgtaaaatgcagtcctgccgtcggagcagccgcagatccggaatgctttgcatacacggtctggtaacgattcttgtcctccagctggtgggtgatgtaaggcggaagcggcatctgtccaagctgatccagaatctcttcaaaaattccttcgtattcaaaatggatcagacggtttccttcctctacaacctccagaacttcccctttcagaagaccgtccccgaagctgactcttgctccgggtttcatcttctttcctggttttacaagtgtttcccagacatcatttccttttcgttttaaaagaagaacttcgacttttccgccggttccttctttttcaccgatcagtcttgccgggataaccttggtatcattgatcacaaggcagtctcccggtttgagataatctttgatctcacggaaaatgtgatgactggttgcaccggtttttttatcaagaacaagcagtctggaactggatctgtcttcaagcggatcctgcgcgatcagctcttccggtaaatcaaaataaaaatcctgtcgtttcattcttttgacctcttttcgcctacttacgaagctcgatacccatttcctccagtgcctttaagatacggttcatagcagctgaaatgtcagcttcttccagagtcttatcttttgcacggaatgtgatagagtaagcaacagacttgaagcctgccttgatctgagcgccttcatagatatcgaacagcttatagctttccagataagcgccacccttgttctcgatcacttcttcaacctgtcctaccaggatggattttggcattaccatactgatatcacggctgactgccgggtattttgcaattccttcgtattttctgtcaaatgttgcaagctctatgatctgtggcatatcgatgacagcaatgtatgctctttcaccgattccatagatatcagcaacttccggatgaacctcacccatgtatccgacaacctttccatcgtaaacgatgtttgcctgacgtcccggatgaaggaagttctttcctgcatttggatcataagtttctttcttatgaagtccgactttttcaaagaactcttctacaacacctttcatactgaagaagtctccatctccgtacattccaagtgtaaactgcattctttcgtccggcagttctgtcagtggaagtgcctttggaagataaatatttccaagctcgtacagacggacatttttatttcttctgttgtagtttgttgcaagagatgtcagcataccattcagagatgttgtacgcatgacactgtaatcttctccaagcgggttcatgatctggattgcctgacgcatcggatcatccttgtcgaggaggagcttgtcaaataccttcgggctttcaaatgaataagtcattccctggctgaatccacagaattctgcaatatttcttgctacttcttccacacgaagcttgaaagaaagcttaccagttgtagcttcacctgtaggcagtgtagtcgggatattatcatatccgtagaatcttgctacttcttcagcaagatcggcgatacggaataagtcatgacggaaggttggtgcgatcacttcttttgcttctgcatcatattccaggtcgatcttttcaaaatatttgatcatatcttcttccggaatgtctgttccgagaagtgcattgatcttgtcggcatcaaatggtacacgtacaggttcttttttcttgctgtatacatcaaccattcctccgacaacttcaccggctcccatttcttcgatcagctggcaggcacggttgattgcatcctctgcattattcggatccagtcccttttcaaatttaccggatgcatcggtacgaagtccgactttcttgctggatttacggatgttggttccatcgaagcatgcagcttcaaataacatggtttgtacattgtcagtgatcatggaattttcgccacccatgattccggcaatacctaccgctttttcgccatcacagatcatcagaacagaatcatccatttctctttcctgaccatccagtgttacgaatttttctcctttttgggcattgcggacgatgatctgatgacctgcgatggtatccagatcataagcatgcattggctgtccgtattcttccattacatagtttgtgatatcaacaaggttgttgatcggacggattcctacggaagaaagtcttctctgcatccatttcggtgaaggtccgatcttgatattttttatgactcttgcacagtaacgtgggcaaaggtctgtattttctacttttactttgatgtaatcattgacatcttcatcatttccggttgatgttacaaccggtggcttgaattctttgtggaatgtagctgcaacttctcttgcgataccaaccacgctgaagcagtctacacggttggaggtgatctcgtattcaaatacgacatcatccagtccgagtgcctttactgcactttctccgacaactgcgtcatcatcaaaaatgtagattccatattccggtgcttccgggtacatgtttctgtctgaaccaagttcttcgatggaacacatcattccgtaactgtcgactccacggagttttccttttttgatcttgattccgccttctactctctgtccaggctcatgtccgcccgcaacgcgtccgccatccagaacaaccggtaccttgtctccttcttttacgttcggagcacctgtaacaatctgtacggtctctgttcctacatttacctgacagatgatcagtttatctgcgtccggatgtttctcaattttctcaatctgtcctactacgatcttatccagatcagcatccagctttgtaaaaccttctacctttgttccggaaagagtcattgcatctgtatattcctgcgctgttacgtcaagttccggaacatacgctttaatccatgataatgaagtatccattttatatctccttctgatttgtttataaatttcccttattcagactccaaaatccagcagctctccgcgctgctctttgattttgtgctcactagaattgctttaagaatctgatatcgttctcgtagaggaggcgcatgtcatcgatctcgtatttgagaagggcgattctttcaagtcctactccgaatgcaaatccagtgtattcttccggatcgattccgcacatttcgagtacgtgtgggtgaaccataccacagccgaggatttcaatccatcctgatcctttacagaaacggcagccttttccgccacacttgaagcatgatacgtctacttctgcacttggctctgtgaatgggaaatgatgcggacggaattttgtcttggtatccggtccgaaaagttcttttgcaaatacttccagagttccctttaagtcagcaaaggaaatatttttatcgattaccagtccttcgatctgatggaaggatggtgaatgggttgcatccacttcgtcagaacggaatactcgtcccggtgcgatcatacggatcgggagcttgccctgttccatcacacgtgcctgaaccggtgatgtctgggtacgaagcacgatgtctttgttgatatagaatgtatcctgttcatcttttgccggatgatctgcaggaatattcagtttttcaaagttgtaaaggtcatattctacttccggtccttccacaacttcgtatcccataccgatgaagatacgctctacttcttccagagcgatcgtattcggatgacgatggcctactgtatttttcttggaaggaagtgttacgtcaataacttcctgttttaatttttcttcacggattgcagcatccattttcttctttgtctcatcaagaagttcttcgatagcagctcttgtctcattcacaagctgtcctaccttcggacgttcttccggagctacatctttcattccttttaatacggctgtcagttctccttttttaccaaggaatttgacacgtacatcatttaatttctccggtacatcagaagcctggatctgcttaatagcttcctgtttgatgctctcaagtctttctttcatgatatcctccttaaaacttgttttggctattcatttgcgactataacaggaaataaaatttcctgtggaagaaaaaagaatgtgccttggcacattctggcacctgcggcggtcgcttgtgacatcttccttatacgccgcagtacacatcctcgcggagcgtttttatacattaagaaagaacactttcctaatatataaaaaaaaatcgcccctgaaaagggacgagataaatcgcggtaccaccctgtttcctgctctttgaataacaggcactcggactgcgtaacgtgcagggacgtcgttttctactttattttcaaaaacgcagctcacgtgggaaattcgtttcctgcctgaaccggggagaacttacagccggggattctccttctctgtcggaaaacagttcactacttacacggtcattgcttttatgatatgtcatatacttaattattgtaacatatgatttttttatgtcaagcggttttatctgatagattcaccgtttatctacgcaaaatcatattccggaacctggatgccgctttttgcagaactaatccttttccaggatatcccgctttgcatcaacccagatacagttaataagccctcccagcagcatcacatacatacagaaatacagccacaacatcacaagaatgatcgccgtcatacttccatacagaccggaaaaccctttgaagattgtcagatacatcgaaaaaacaaatgagatcaccagccatcccagagagcagaaaatagatcccagaatcagatccctgaacggaagcttccggttcggcaaaaagtgatataccagaagtgaaattccagtcatagcaacaaatgaaatcaccgttctcaaacgcatgatcatatccgtcgtctccgcaagaaacggaatcttgtgatatataaaaatactgatattgttaccaaacacagaaagtaccagagccatcacgatcgctgcaatgaaaaggatcgtatagatggatgcccggattcttaaaaatacataatttcgtgtttcacgaagctcatatgcacagttcagtccggtactaactgcaagtactcctttgcctgctgaccacagtgctacgattgcagtgatcggaatgaccgtcttcgactggttatatacttcatttacaatgccaaccataaaatcctgcatatttgtctccggaaacaaatttaccactgcagtcataacatctgcttttgtcaccggagtatattgtatgatagcaagaagcagcaaaataatcgggatcatactcagcacaaaaaaataagcagactgggccgcgtatgctcccacatgcttttgtgacacctgccctgtaatttcccgaatcttgtttatcgttttcatcatataataactccatttatcttatcggcagtttcatttttcaaaatagtttatcacattttcacttctttgaaaacccaaaaaaacagttgctctcgcaactgtcctttatcttttgtagtcccccgaaatgccgttttccgttttttgactcctagcactccgctaggtgggaaaccgcatctgcttttctgccttcccctgcgcaatgagggcctgacatattacagagatataagaatcccgtttaaagtattgtaggttcaaaaatacggaagtctcgaacattccaggttttctaaagcctattatagactatcagccgtgttttttcaactgttaatcgttgaagatatttactttttttaccagaaattaaaatacgtttaacgtacccatttcccgctttttccaccggacttttcaagcagatggatttctctgatctccattccccggtcaaccgccttgcacatatcatagattgtaagaagagcggtatttaccccggtcagtgcttccatttccacaccggtcctgccggtacatgccgtgtggcagattgcccggatcccatgctcttcttccagatattcaaaatcaatctcgactttggtaaggtttaacagatggcacagcggaatcagttctgctgtcttttttgcacccatgatcccggcaattcttgctacgccaagaacatctccttttttcatgctgcctttctttactttctgaaagcattcttccgacatgcggatcacccctgatgcaagtgcttctctttttgtctcagcctttgcccccacatctaccatcactgcattaccatcttcgttaaaatgtgtaaatccactcatgatttttaacctctttattttctggcacattcgccttctgttccccggaggattccaagcccatgtccaagttcaggaagcagaaactccagtgcttcctgtactgctttgggacttcccgggagattgatgatcagcgttttttttcggatacctgatacagctctgctgaacatagcacgctttgtgatcgtcatcgaataattccggattgcctctgctattccgtttgccatccggtcacagacatttaccgtcgcctccggtgtccgatcccgctcggagaatcctgttcctccggtggtgaagatcacattaagctgtctctgatcagccaatctgatcagctctttttccagttttttctgctcatccggtaataaaatcgtttctttaatatcatatccggcatctttcaacatttcgacaatcatgggtccgcttttgtcttctcgttctccggcagcccctttatcacttaaagtaataactgccgctgaaaatggacggtcacttttcacctgttccatgacaacttcatcgcctaccttgatatgacctccggtgacgacttctgcaaaaacgccctctcttggcataatgcagtcacccattctcttataaatctgacaatgactgtggcattcttttccaatctgtgtcatctcaagtaccacatctccgatatgaaatcttgttccaaccggaagcgcgcgaaaatcaaatccttccacgatcagattttcaccaaatgcaccatacgcaacttctgccccttttgcacgaaattcctgaatcttttcatcggaaagcagactgatctgacgatgccattttccaccgtgcgcatctccttcaatcccccagtccattttgaccatggcttcacgaacctcatgtttttcggttcctctcttttcactgatgcagattcccttcagtcttcccatttttatgtttatcctccgatctgtgacatatttttctgttctgtaataaagttctgctcctcaaaatgatgcatcttcggttttccacggatcgcctgttcgagacatttccggatttcttcttccgatccgtgtcttgctgcctcaaaaacggagatagtatctgcatagcacagacacgcttttaactttccggttgatgtcatccggatccggttacatctgtcacagaattttccatgcaatgcactgatcagaccgatttttccctgaaaaccaggcagttgataatacacagcaggtccgttcccaaatcgtccctctaacggataaaactctccttctatcccataagcttctttcagttttccaagcacccaggcaccggaaatgccattctctgctcttccctgtccaatcggcatcaattcaataaaacggacatccagcttgttctttttcgccaactctgccagacttttccattcctcatcattgactcctttttgcaggaccgtgttgatttttacccggatctcgcttttttctgccatgaaaatggattttctgactctttccagttcatctgccccggtaatctcctgatatttttccggaatcagtgtatccagactgatattcaccgcatccaaccccgctgcaagaagatcttccagattctcacccagaagaaccccatttgtcgtcattgttacttcttctgtgcccggaatctgccggatcatccggatcagatctgcgcatccttttctgatcagaggctcccctccggtaatcttaaacctggtaatcccgatctggacagcctccctgcagattcgttcaatctcctcataagtcaggatttctgacataggaatccactttgcgccatccggcatgcagtacctgcatcgcagattacagcggtctgtgattgaaattctcatatattcaattgttcgtccataagaatctctcacagccttttccatcctttcttaattccagagtggttccagtaacacctcgatcgtaccgccgcagaccatgccttcttcctccgcatcatctccggtcatatccacatattctgtctttagtcctgtattattttcatgcatcatgactctcgcttttcttaaaacctctgcctccatacagccgcctccgatggttccaacacagctgccgtcttccaggatcagcatcttggatcccacatttcttggtgcagaaccctttcttgtaatgatcgttgcaagcatcttctttcccggatgagcgatatccaggattgcttccagcaagtcttccggataaccgcagactctcttgttctgattctttacttcgatgatttccgccatgatcgccacaccgatctcctccggtgtctcagcaccgatgttcagaccaatcggactttttatctcgccgattacttcctggctgcatcctttttcaatcagattctgctttaccatcgcacttcttcgccggcttccgatcattccgatataagcatgttccttcccagcgatcttctccagacaaacctgatcatatctgtgacctctggtcagtacaacaaaatacgtatccttgtctccttcgatctgatccaaggcatcttcaaacggctggcagattacttccgttgcccccgcatttctggcatgatcggcaaactgcggacgatcttcaagaaccgtgaccttccatccaagcataatcccgattttgatcaccggcaccgatacgtgaccaccgccacaaatgaccagatgctcctgccctccaattatatcacaaaacacctgctgctctctgatttcataaagtccgcactttttcaagtctcctgcttctgaaaaatgtgctgaaaagaaaccgttttctttactttcccagattatttttttctctgccaaaattgctttttctccggctgcggatccttttgccactgtcaaaagaacgtaatcccccggctttggtaaatcttttaatatctcaaatacattttccatcaaatctcatctaccctactacatatttattcagtctgtcaaatgcttcttttaatacggttccatcctgaaacggatcggaatcttccggcatttcatctctcgcatgacattttcttttatccccatcacattttctctgccatgcaatacttttattgtaacaaatttttccgccaaatgaaataagaaggtgcagctctttttgtctgcaccttcccttttcctttattttgtgatctgattttaaaaatactttgcattcagctttttgactgtccatgcaaaccataccagtactgcaagtaccagcactaacatcacccagaataattttcctgtactctgcacataagtattatacagatcttctgcgccgtacaagatcagcactaccgcaagcacaagaagcttcggtcctgctgctgccctgtatgcttccttatccttacacttctttatattcgtatcttttggtacaagaattgatgtattgatgattcctttgaatttaagttgaaaccatgcatacaagctatacaatcccgccccaataccaatgatcccgaaaattccttccattccgttcattcttttgccttctcctgtctattttacgccaagaatattcttaacagtctgctccatctgattcacatcacattccgtattgtgacggatctcggcattcatgatctctttgatggcattcggaagctctgtaccggatactttctgaagctcctcgatcagtttgaaatcatcctgtcctttatacttcggatcgatcgctgacataacgcttcctgcaaatttgtatggacttgctgtggatgcgattactgtctttctgtcatctttactgtcttctctgtaagctttatacaccgttgcagctaccgccgtatgggtatccattacataaccggtatcttcgtatatatcatggattgtctttgcgacctgctcttctgtcgcatatcctgccgcaaaatcagccaggtttgctttcatctcacctgtaatcgcgtaacttccctttgtcttcagctcagtcataagatccgtatcttttcttgcatcttctcctgagatcttgtagatcagacgctctaagttgctggagatcagaatatccatagacggagatgttgtaagaacaaattcacggttacggtcataagttcctgtctggaagaagtcatagagaactttgttctcattggatgcacagatcagctttgcaatcgggattcccatattctttgcgtagtatgcagccagaatatttccaaagttaccggtcggtacaactacattgatctcttcatcttccgcaatctcttcattctgaagaagcttcgcataagcatatacataatatacaacctgcggaaccagacgtccgatattgatggagttggcagatgagaactggtagcctgcttcatttaactctttttccagctctttgttctcgaacatcgccttcacaccgctctgtgcgttgtcaaaattaccgtgaatcgcaacaacagaagtattgtctcctttctgtgttaccatctgcagctcctgtacgcggctgactccgttcttcggatagaatacgatgatcttggttccttctacatctgcaaatcctgcaagtgcagcttttcctgtatccccggatgttgcagtcagaatgacgatctcattcttcacctgattcttctttgcagaagtagtcagaaggtgcggaagaatggaaagtgccatatctttgaatgcgatcgttgctccgtggaacagttccagataataagcatcttccactttcgcaagcggtgcaatctcttcggtatcaaacttactgtcgtaagcctttgcgatacagctcttcagctcttcttctgtaaagtctgtcaggaattccttcataactgtatatgcgatctcctgataggtcatctctttgagctcaccaagcgacaccggaagcttcggaatcaaaaccggtacaaataatccgccgtcatctgccagcccttttaagattgcctgggaagctgttactgtcttttctgcatctcttgtactcttataaagtaaattcatggttctccacccttcttattctttctgattcacttcagcaatctgctaaagtattttcctatttagcgattatagcataagaatctttcaagtgcaatgccatccttatctgcgtttccacattcgtccccacatccggctcagaagaaaacacaggagcagtgccccggtcagaataacgccgatcagaaataccagaatctttacataagatccatctcctgttgcaaccgtctttgctttctcagtttcctttggcttttccggactttccggttttttctcttctacctgcttttcctttttataggttacactctgtccttcgtcctccagatctgcgtgcactgcaaccagcttctcttccagatacacttcctcaaatacaacaacctgttctccgctaagcttcgttgcatcaaacgtaaattccatctgaagttctccggaatctgtatccgggatcagctttttctctgctgtcacttcttttccatcctgaagaaccggctttttggtctccttatccattaatgtgcctttaactacatattcttttccaatctccagatttttccattttacccgatctatgaccgttacctgttctgtccgtttcccattatgcgttcccgtttcccggtcagatgctcttgtcccgatcttcggtacgggatgttcatcatttgtcagtgtccccagatcaattattcgcatttcctttgttacttccacctcaaacgcaggaatcagcatccggtcttcattatttttacaagacagttcttccaccagatacgttccgtaaggaagcgctcctcttgtattatccggagttccttccccaaaccagatcccatcttcacttgtttcccccttattcgtgttgacggtatgtggattccagtacgcaccggtcgaagcctccccgtttttgtccgtcagaatcacatggctctccccagttgcctgcgatgtgatccgaaatgggatatccgccagtcttttcaaggttttatctgccgctttcaccagctttaagtccccacggatgagcttttcctttatttccactggattccatattttcagggctttatagtttccattttgctccgttccagtcctgatacaatgtgtaacggtgtccaccagatacccttccggcgcatgcatctcccataccgtaatcgttccaagcggaagctcgttattttcaaaaaacggatctccgctgatcaggtgcgcctcatccatacggaccacaccatccgcatccgacttcagcttccaactcctgagcggcaccttcacaccgatctcattttgattgtcaaaaatgctatcaaaaaatgccacatgaaattcagctcccgcaagagaaagtccttcctgcgcctgccctttccctgtttccgcatcctgcttccggatcaggatttccacctttgtcttttctggttcatcctgacactcataggtcacggtctgtccggcattcaccgtgatctgccacagctttgtgtccagtacatagccattcggtgctttagtctctttgatgtcataggaaccctccggcagattttctgccttcccatatcctttcttgtctgtccggattacgcagactgcctcggatgtcccacttttacagacggtatactctgccccttccagtgagtagagctgattatcagccgtaatctctgaccttgcagagctcttcatgatctccaggcttccgttatgggttgtcttaaaaagatatatcgttgatctggattttgccacaagctgtgaaatctgattgccactcgacgggatagatgctgaatgccagaaccggttatcgttgctattatctccccagaaaaatccgatatggcagtctgcatcttcttcctcccaggaaaccggctcaaaatagatcacatctcctttttgcgcttttccgcccgcaagcagctcctcaatggtgttgtaatgataggattccacggcattgtctgtcatccaatgaaaccagttgctcgcattgaccttgccgccacggagacttcctttgtcaattcctgacagatccgctccacatttttccagaacataagcgacaaacccggtacagttcattgccccatttccgccgtaggctccgttcggacgcatgcagttctctgctgtcagaggatatccgctgtaaggcgttcccagataataaccgtccttttcgtggttttttaactcctcaagcacttttcccggctctgctcctaatttttcatcaagttttacaatcgtttctttctttgcgattctctctgctgagtttgcagatacgacaggcatactgctgcccgacaatgatactaccgccagaatcacacttagtattccggcaaaatgattcttcatatatttcataaaaatttctccttctgccttttcaggtcagaaaagagaatataaaagacgagtacccttactataaaggaagagtacccgcttgtcaatagtattttattgttgatctgcctccagaacgatcacacttctcggtcccacaagaattctttcctccgaaatccgtaccggattctgataaatttcctgctttttatctccagtatttgccgccacatgccaactatatccgcccggaagttgtggaagttctacccagacaccttcccagtatggattcatcagaagatacacacagtcttcttttgccattttgttatcatatccggcaaacatgactgccgccgtccggatctccggtctggaaaaatccagtttccacggcacttcaccgtgaaagctgatctccggaaatccaagactgctcgcccctgcatctcctgtgatcgacggatgccgtttccgaaatgccgtcatataagcacaaaaatcaaatacatcctgaaacttttcttttcttgtccagtccagccaggaaatctcgttatcctgacagtaggcattattattcccgaactgagtattgccaaactcatcacctgcaaggaacatcggtgtccctctgctgcaaagcaggaccgcaaaagcatttttcatcatccggtggcgcagttcaacaaccataacctgatcggtgtccccctctgccccacagttccagctccggttatcgtcacttccatcaagatttccccatccattagcctcattatgcttctggttatacgaataaagatcatacagggtaaatccatcatggcaggtcaggaaattcacagaagcatgttttccgcggattctggtatcatagatgtccggagaaccggcaattctctgaagcgctgctcctgctgcccaaagtcccccttttaaatattcccgcacgtcatcccggtatcttccgttccattctgaccatctgcggaatgccggaaaacttccgacctgataaagtccgccggcatcccacgcctccgcgatcagctttgtgtctgcaagcagcgaatcataggcaagattctttacgagtggtggattttccatcggtgacccatcctcatttcttcccaggatcgatgcaagatcaaaccggaagccgtccacccggtactctgccacccagtatcgcagacaatcctggatcattttgatcaccaccggatgattacaattcacagtatttccacagccactgaaattataatattttccatcgggtgtcaacatataataaatctgattgtcaaatcctttaaacgaaataaacggtccgcattcatttccttctgccgtatggttaaacaccacatccaggattacttcaatctggttatcatgcagttcccggatcagttcttttaattctactccttcccggttgtattccgttgatgctgcatagctcgtattcggcgcaaaaaagctgactgtattatacccccagtaatcaatcagtttctttccatcaacctcacgactcccctgcagttcatcaaattcaaagatcggcattagctccaccgcattaatccccagtgttttcagataaggaattttttctttgattccggcaaaggttccaggatgacggacacttttgtccatcttcgtgaatcccctgacatgcatctcatagatgatcagtttttccatcgggatcttatccggcttttcactgccccagaagaaattattccggactactctggcacgatatccccctgtatttagtgcttttccccatacactctgtccggtaactgcctttgcatacggatccagtaaaatatgctttttatcaaacagcagaccttcctttggtttccacggtccatccagcctgtacgcatattcaaattcttcaatatccagtccgaataccatcatggaaaatacatccccaatccggcagttttccgggaatgggatcaccgcataaggttccggttcctttctgtgaaacagaagaagtgcacatgtcacagccccttttgaatgcactgtaaaattaactgccgactgaaatgcagtcgcaccctcatcacgatacagtccgggacagatttcaaatccatttacattttctgtcggaacccatcttggcatcatttcttccagcattttaccagctccttccatgtcatgttttcagtatagcacatttttccgtttacacatctttcctttctgtatataatataaaggattacatatttttttgcagcagactcaaggaggttttttatgactgcacagcatctatattatttatttcagtgcttctttatatatgcctttttaggctggtgtacagaagttgcgtttgccgcttttaaagaacgtcgttttgtcaaccgtggattcttaaatggcccgatctgtccggtatacggtttcggcgtggttgcagtcattcattttctgacaccgcttcgttccaacctgctcctgctatatctcggaagtgctattcttgttactgcaatcgaatggctgaccgggttcattctcgaaaaggttttccataacaaatggtgggattattctaatatgccgctcaatctgaatggatatgtgtgccttttgttttctctgatctggggagtgttctgtgttttcatcgtagatgtattccatccactgattgacacactgctctcacacattcctttccttgtcggtatcattcttgtatgtattctggtgattgccggacttgccgatctctatgtaacagcatccggtatcctgaagctcaacaaacgtcttgaaaaaatgcaggccattgcagacgaacttcatcagatttccgacaagcttggtgaatcaatctacaagcgtaccattacagctatggaaaaacaggaagagttcaaagatactgtatctgagaagcaggaagaatttaaatctgctatttccgaaaaacaggaagcaatttcagacacccttgccgatgtttctgacgaagtaaaagaacggattactcttcttcgcagaagctacctggaaaatgtcaaagcaacttctcatatgcagaagcgtatcatgaaagctttcccgaaaatgcagagccgcaattacaaagaatcctttgaagatcttagaaacaaactgaaggaaatgtctctcaaaaaataacaggttgtaaaaaatccatctggttttcttttaaaaaaagaaatcagatggattttttatctttaaaattatgatgtgagtatcaaaagtaaattttgccactcactaatgtttcctcttgatcttgtccagatacggaatctcgattggatcgattgcatcaagtggctgttctttattgatcttctttttgcgtgtgtgctttttcagaagtgcaccaccccggttataaaaccagaaagaaaagatcagaagtttattgaattttccaattttgtcttttgtcgtcttcgtgtaatactccccaccggactggatctctcctttttccctgatctgccggatcagatccagctctgtctcaatccgtaccggaaattccgtataccccatgccgacgcagtccagcttatgcgcatcacttcctccggttcccggttttccatatttttcagcaagatacttcgccccttcattggactgtggtggctcacatgcattgaaagtctctataaaatcaaatttttcaatcaactccggagatttctgccatcttttcgtattcgtaaaactcagatacttttccccacacggatgtgccggtccacagattcctccattgtgatgcacaaaatcaatcagcagcgaaagcggtagccctctcagctccagaaggcgcatctttactccctgtggcataatgatcagaatgtgtcccgcatccagtgtatcatactctattcctttcaatacgacaaaatctttgtattttctccctttgaccgtattcttccagtgccgatatccattataggtgtcatgatctgtaaccagcattccgccaatgcctttagactgcagctttttaataaattcttcaatcggcactttgctgtcaattgatccttctcttacatgacaatgcatatctatcttcatattttcatctccagatcttatatcgttgatactatttttattatacctctttttttataacgctgcaagaaataccggtttcttccagccattcctgatcaaatgcaaaagaggatgtatcacattctgatacatcctctcatccatcttatctattcttcatcctcgtcatcatcatcatccagatcgatcagcatggttcttgccatctctatttcttcttcttttgatgtttctttcttgatcgcatttgctcttcgaacctgcttcttgttgatctcacttgacttcatgataaactggatcacgattccgataaatgtaatcacaatcgaaatgatccacatgaaaatcacatttttcagacctgccagatcatagatcatcattcctgctccaaaaccgcctgccaatgccgtcgcaataatcacaaacggttcaaaccagatcatcgcaaggattgcgaaaatcagtccgactgctccgcagactgccagcatgatccagtttcccgcatttgtaatcgcaagtactgtgccagccattcccagaaagcatacccagaaagctccgaatttcttaaatacactgttcagtattgcaaaaaccaaacccgcaacaccggctgcgatcagtaccggaacaacttccagtcccataagatatgtcacggcaaatccaagcaatgcccctgcaacaaatccaatcactgcattccagacacggatcagcttcaaacctaaaattccaatgaaaaccgatataacaattgataccgccgaaacaatcacggcttcttttcctgctataaataccgcactgtttcccatgatatccttcaatactatacctattgattccatcctaatctctcctcctgtcgtactttcctgttgttaagtcagacgcttattttgatgaagagtctgaagatgtatctgtatcttcggtcgtgctcttaaccgttacgccctgatcagcaaaactgatcgtattccatacttttttatgtactttaatatccgttttctttttccatttcttacaaattgactgatactggtcactctttctctgtgatacaatggactctttcttggtatccgttgcatcacggtcaagaaggctgactacttttgcaacataatagccattgtctgcttcgatcacgtctgttacttcgccttcttttaacttatcagcagctttgatcagatcttcgtttggcgatgtcgtatccgagtcaaatgtcagatcggtggctgatgcacctactgctgttgcaaatacagaaaaatcttctgccgaagccgcatctttctggaaatcttctgctttctttttcacttctgctttttcgtcatctgacatatctgtcgaatttccatcactgccctttgtctttgtagagaacagcacatactgcattttcttctgtgctgcttcctcatcggatacattcgtatctacatccgcagtcatggcagtttccatcttcttctgaagtgtcagaagttccagtactttctttaccgtcttttcatcgcccgatactgcatcttttgcagcactgtcattgctgtcagtaaatttcttcgcaacatcctcgatgcttttttcctcatcatcacttagcgaaactttataatcatccttgtgctcatccagaatatacatttcttccagagaatccatgattgaatccttataattctcttcgtaagtctttccgtctgtaacttcttttccccaaaaatcatctcccagataactgctatatgttgtttcaaactgcgcctgctgatatcttgcaaaaaagttcgccacatctgcagtcactttctcatctccgacttctaccactgtatcctgtccgttaaacttgcttccacatccgtttaaagatgcaatgcaggcaactgccagtatacaggcaaccactctttttttcatttataaaatttcctccttgatcttcactccattgtacacacttcttcactatgcactcgtatagtatatcttttttttaccttactggcaatctttttcataaaaaatacacattattcttcgacaagtccctgtatatcttcgacaatttttcctgcattttcaagaatctgctctgctttttcttttttatttttccgaagtttacaataaataaaatatggattttctgcatctgtcttaaatgtcagttctcccttatattttgccagcagttccggaatctttgctacatttacccttgccttctcatacatggtaaatttgtattcatcgcctttttgctctaccgaaattacataagccgcatgtgctttcgccttcagctgcgcgatcatcagaagctgctgcaccttgcgtggcggatcgccgaaacggtcaatcagttcttctagcatatcttcctgttcttcttctgtctcaattgctgcgatccgtttatagatatccagcttctgatactcattcggaatataagatgccggaatataagcatcaatattcagatccacgtttgtcgcataggtttcttccgggatctctcccttcaggtgacggactgcctcacttaacatcttacagtaaagatcgtatcccactgcatccatatgtccatgctgttcctccccaagcaggtttcctgccccacggatttccagatcccgcatggcgatttttacaccagagccaagatctgtaaactcacgaattgccgaaagacgtttttctgcaacctcccggagcattttgtctcttctgtacaaaagaaatgcatatgccatacggttcgatcttccaactcttccacgtagctgataaagctgggagagccccatccgatctgcatcatggatgatcatggtattggcattggaaatgtcaagaccagtctcgatgatcgtcgtcgataccagaacatcaatttctccattgatgaaatcgtacataatatcttctaacttgtgttcccgcatctgcccgtgtgcatatgccacatttgcatccggcacaagtttctggatcttcgctgccatttcagctatatcctggacacggttatagacatagtacacctgtccctggcgggaaatttctctttcgattgcctcccggaccatctcatcattctcctccatcacataggtctggatcggcatccggtcaattggtgcttcttccagcacactcatgtcacggattccgatcagactcatatgaagcgttcggggaatcggtgttgccgtaagtgtcagaacatcaatattttccttcagctttttgatcttttctttatgctgtactccaaaacgctgttcctcatcaatgatcagaagtcccagatctttaaatgccacatccttactcaatacccggtgggttccaatgatgatatcaacctgtccctttttcaaatcttcgatcgtttttttctgttgtgcaggtgtgcggaaacggcataacagatccacccttaccggaaattctttcatccgttgcacaaaagtgttgtaatgctgctgtgcaagaatcgtagtagggaccagatagacaacctgcttgttctcctgcactgccttgaatgctgcccggattgcaatctctgtctttccaaatcccacatccccacagatcagacgatccatgatctttggactttccatatcccgttttgttgcctcgattgcaagctgttgatcctccgtttcctcaaatggaaacatttcttcaaattctttctgccagaccgtgtccttttcatagacaaatccttctttggactgccgtactgcatagagttccaccagatctttggcaatctgccagactgctgtctttaccttgctcttcgtgcgatgccattcctgtcctccaagtttgttaagtttcggctttttagcatctgcactggcatacttctggatctggtcaagctgtgtggcaagaatataaagatttccaccatcagcatacgaaatcttcatataatcctttgtcaccttatcaacttctatcttttcaattccccggtagattccaagtccatgattctcatgcactacatagtctcccggtttcagatccgaaaagctgcttattttctgtccatcataactttttcgtttctttttcttctttgtctttccaaaaatatctgactcagatatgacaataaatttaatcatcgggtactcgtatccgacttctatatgcccgtagcataccatgatctcccctggattcacttcacgttcctgatcctcactgtaaaaactgctcagatcataatcacgtagatcctctgccagacgttttgcccttgttctggacccagaaatcagaaccgcccggtatccgttccttttcagtcttttgagatcctgtgtcagcatctcaaagctgctgttatacgggttaacgctttttgcctggatcccaaaccgctttttcacaaaaaatggcttacatttcatttccagagcacacatcccgatcatacagaatttgttcagaaattttataatttcatcagtcgtaaaaaattccggagcttcttccatttccccggtcctttccatttcttctgcacggttctctctcgctttttccacttcattttctgccagacgccctttttccagaagccttgctggttcatccaggaacaccagtgtgtccttcggatcaaagtagttgataaaagaaactttccggtcacttcccagtctgtcatctgccggataaataacgatctgttccagattctctacagatctctggctgtccacgtcaaaagtccgtattgaatccacttcatctccccagaattcaatacggatcggcaattcctcggtaagtgggtaaatatcaatgattccaccacgaactgcaaactgccccggaccatccacctgggcttccctgtcatatccaagttttatgatcttctccttcagcgattcaaattccagcgcctccccattggaaatggtcagaatgtctccttttatttctgcttccgatggcagttcatccatgaatccgtcaatcgttgtaatgaccgtaacctggctttttgcttccatcatcatctgcaaggtttccatccgctgtttgaccagctgttttccgtggatatctgcctgataaaaaaggagatcctttgccggataatagctggtattttcatttaagaaacgatattcttcgtataatttttttgctttatcttcactggaaagaacgatcaatgtatgcccataaccttttccaagcgcatacatcaaatgcgttttctgtgatgtcacacacccggaaagaagcagcatgcccggttcccgtccacgctcttcacagatttcttcaatctctgccagttcagataaaggagccgtaagtgcatgcatcgctttttgcctcctcttattctttctttttctggttatattcgttcattgcctgatcgattgctccctgcatgatcagagcagaagcttcacaggcaagatcatatccttcttccataagtacacggtcctctttggaaaattttccaagaacataatcagcaagatcatatcctttcggtttttctcccacacctaccttgatccgtggaaatacactacttcctaaattggcaatgatatttttgattccgttatgtccaccggcacttccttttctgcggatcctgagttgtccgacttccagactgatatcatcataaattacaagaagttcttcttccggatcgatcttgtaatattccaccagactacggatactctctccacttaggttcatataagtctgcggcttcacaagaagcactttctgtccctcgatcactccttttccgatgagggcacggtgttttttagtatcgactgctatctggtatttctccgccaggcggtccaccacatcaaatccaacattatgtcttgtcccctgatacttttcatccgggtttccaagtcctgcaattataaacattctattcacctctgctttttctctttcctgattctactaaatcctttctcttttgtcacgcatttctcatgcataaactattttttcttttcatatagtttattaagcggcataacctgccgaaattccatactgcctaaggaggttctttatgaattccaaaacaaaaatcatcgtacttcacatgaaagaaattatctatactgttatttttgccactttaggtattctcatcctctgccttttattctttatgttctccggagaccggcattcctctgtatccgacaaaaaatatactcccggcgtttatacctcttcttttacactcggaaatgaagatctggaactggaagtttctgtctctgacacctctatcaattccatccgcatttccaatctaagtgagacggtaactgccatgtatcctcttcttcagccatctcttgagaatctggctgaccagatctgtaaatcccagtcccttgatcatcttacactttcaagtgacagtccctatacttctcagcttcttctcaacaccatccgtgatgcgctcaaaaaagctgcggcaaccaactgatgccgcagctcttttccttttattaaccttccacgatcagatactgtccgttcggaagtgcgaatacttctgaagcctcttccagctcttcatcactcataccactgatgtccgctccgctttcatccagataatctctcacatccttgatagaatctacaacaaccgccatacagtcttccaaaaacgcttctgcctcttccagtgtctctgcaaccggctcatcaaaaagctgtgactgcatattcaggaatgtctgcagacattcttcatcatactcatacatacaggcaaccctcccttatctttctcacagaaaaattttctcatctgaactataaatagttaagcaattcttcagcatgtgcaattgttgcatctgctcctgtctccacaagaagttctttggtccggaatccccattctgctccgactgtaaacataccggcagctttccctgtcttcatatctacatccgagtctcctatgtatattccttcttccggcgatacccctaatttatcaagtatccacagaagtccttccggatccggtttcttcggaaattcacccgactgcccctgaatatggtcaaaatatccttttccaaatgtactttccactacatcgatcgcctgcaaatgtggtttgttggaaaatactgcaatctttattcccttcttcttcagtgaatctaacatctgaacaacgccatcataaggacgtacatggtacatacaattttctccaaagattctgctgtacacttccataccttcttcaatcctcttaagctctgtgtctccggacgcacgaagtgcacgttccataaggcatctggctccatccccaacgaagcttcggcactgatctttggtaatcgtcttaagtcccatttcttctaacgtcttattcgttgaataagtcagcgaatccagcgtatttgtcaaagttccatccaagtcaaaaatacacgctttatacattgctgttctcctgttcttctgttctatgattataatagtatgaaccttgacaaatttcaactggaaatctctatttttctattcacttcgcagatattgtcgcatagccctgagtgcattcttttccaggcggcttacctgtgcctgtgagattccgatttcttctgctacctccatctgcgttttaccttcaaaaaaacgaagtctgataatatacttctccctttttccgagtcggtccattgccgcctgaagggacagcttctccacccatctgtcttctttgttccttttgtcactgatctggtccatcacatacatagcatctccattgtcattatataccggctcatttaagctgaccggcatctggatcgcatccagcgcatagacgatctcttcctttgcgatcccgatttcctctgcaatttcctgaacagtaggttctttctggtttactttgacataattttctttcgcgtaaatggctttatatgccgtatcacgaagtgacctgctaacacggatcgaattattgtcccggatgaaccgccggatttctccaatgatcatcggtaccgcataagttgaaaattttacttccagctccggattgaaattattgattgccttgatcagtccgatgcacccgatctgaaacagatcatccggattttcactgcttcccgaaaagcgtttgatcacactgagtaccagacgtagatttcctttgatatactgttcttttgcctcctcatcccccgctttgatcttctcaaaaagcacctctttttccccgtcgctaagcaggggaagctttgctgtatttacaccacagatttctactttattaagtaccatctcaataaacctccaaatctttactggtataaatttttctcaaaactgtttttatttattcgattcccactaaaatattaaaaatatcgctccttgacttttcccatactcttctgaaagaatatacatcttagtaatattgtctgattttctatcatttttctttaaattatagtataatatactaaaataatttttacgcaaaggggttgagtatatgaaacttacttttatcggtgccgcccatgaagtaactggaagctgccattatcttgaagcatgtggaaaacatattctaatagactgtggactggaacagggacctgatctatatgagaatcaggaaatcccgatcaatccttccatgatcgactatatcctcttaacgcatgcacacattgaccattccggcaagattcctctgcttgtaaaaaatggttttaaaggagaaatcatctgtacattcgccacctctgatctgtgcagcattatgctccgtgacagtgcacatatccaggaatccgaagcagaatggcggaaccggaaggcacttcgttccggtgctccgctttacgaaccactttatactgtacaggacgccatgaatgcagttgcacttcttgcgccgatcgattataaccagacgatccagctctgtaaaggaatcgaactccgcttcacagatgtcggtcatctgcttggttcttcctgcattgaagtctggatcacagaagacggtgtaagcaaaaaaatcgtattttccggagatgtcggaaatattgaccagccgatcatcaaagatccgcagcatgtggatgcagccgattatcttgtcatcgaatccacctacggaaaccgggtccattctactgtaaaaccggattatattaaggatcttaccagagtcctgcgcgaaacctttgccaaaggtggaaatgtagtcattccatctttcgcagtaggaagaacccaggagcttttatactttatccgtgagatcaaagaaaataatcttttgccggaatatcagaattttgaagtttatgtagacagtcctctggcgatcgaagcaaccaacgttttccagaaaaatgtacagtcctgctttgatgaggatgcaatggctctgataagtaaaggaatcaaccctcttcttttccagggactgaaaaccacgatcaccagtgaagaatctaaaatgatcaacttcaatgacaaaccaaaagtaatcatctctgcttccggaatgtgtgaagccggccgtatccgccatcatctgaaacacaacctctggagaaaagaatgcacgatcctcttcgtaggctatcaggcagttggcactcttggccgcaagcttgtcgaaagcaaaccggaatcagtccggctctttggtgaaaatgtagaggttaatgcccgtattgaagtccttgcagggatcagcggacatgccgatatgaatggtcttctgaactggattgatggattcaaagagaaaccatcccacatctttgttgtacatggagaggattcggttacagattctttcgctgctaccatcacagaccgtttcggcattccggcatttgcaccatactccggaggctgtgttgatctcgcaaccgataccatcctttctgaaggtatcaggcttccgaaaaaagcagttgaaaagccggccaaagcacgtgctcttactgcattcaaccgcgtggttgcggcagccaaacacctcatggatgttgtgcttaaaaatgaaggtcttgcaaacaaagatcttgcaaaattcgagtcacagatccagaatcttgctgacaaatgggatcgtgacgacagataaataccgatcttatctttccagagaccggcttccgacatggaacgccggtcttttcctgtctttttcgacaattcttttaaaaaatccagcatttcagcatgtcgaataaaattattctgttttttccatcttctgacaaaatctgaaacacatcttttctataataaagcatgcttaagtaccaaatctatttagcagctaaagagaaagaaggataagactatgcagtatgaagtatatctggatgtattgtttctggaaaatatgatgatggattttctgattcttctggcagtaaaaaaagtatttccatgttctgccacttatggaagtcttcttgccggttcctttaccggttcactactgacctgtgccattttattttttccatgcccggtatggacccgctatatcctgctgtttttcctggtaaattcctgtatgacagtgatcggattgaaaatccggacatttcccgtttttttcaaagcatggattctgctctatcttgcaagctttcttcttggaggtatcatgagttggctccgtctttattttggaaaatttttccggatcatatcttttcttttcactcttggcatctgtggtttttttcttttatatcatggacttttgtttctaaagaaactatggaaatcacaagatcatagttttgatgtgattttaactgtaaatggaaaagattttcatctgaaagcctttctggacagtggtaatcatctttctgatccactgaccggaaagccggttcatattatcagcaaagacgcctgtcagaagatttcttcccaaatctcacctggaagactccggtacatcccgtaccggactatacagaagacgaccagtattcttcctgttttttctgtcaagaagatgagaataacaggagaatctgaatttttgatccaatctccactgatcggtatttccgaacagaagaattttggaaacggaaaatatgaaatgctattgcatcctgaagattgttaggaggattataatgatgataaaagttgctgtttcagattgttttaaattgaaaatgattccctctttccgcagtgttttcttcccggaaaagcaggaaatccattacataggagggacagatatcctgccgctcccacttagcagtgaagaagaaggtcatgccatttcccttctcggaggcgggcaggatgaagaaggaaaaaagcttcttattgaacataacctgcgtctggttgtatatatagcgaaaaaatttgacaataccggtgtaggcgtagaagacctgatctccatcggcacgattggactaatcaaagcaatcaataccttcaatccagagaaaaatatcaaacttgccacctatgcctcccgttgtattgaaaatgagatcctcatgtatctgcgccggaataacaaaaccaaactggaggtctccatcgatgaaccgctcaatgttgactgggatggaaatgagcttcttctctccgatattcttggaactgaagaagataccatttatcgtgatatggaaaccgaagcagaacacaaacttcttgggaaagccatcggacggctttcaaacagggaacgggtaatcgtgcagatgcgattcggactcggaacccccgacggggaagaaaaaacgcaaaaagaagtggccgatcttcttggaatctcccagtcttacatatcaagacttgaaaagaaaattatgcagagactgcgacgcgaaatggtacgctatgaacagtaaactatgaatatatggctctcattctccggacaggtggctctcaaagtccggacaggtggctcagagagccccggaataatcacaggaacaataggtaaatgctgaattacggaaaagagaatatcttctaatcgtgattttatactcataacaaatttctcctctcatggaaagtataacggaactacagcagcaactcaataacattttgttattaagaaaattatgtttcaaaaatcagatgaaaaatggaacagttataaataagataaaaagaactggaatatgactgaaaacagatgatttctgtttcataaaatattttaaccatttctgaaacaaatttagatttctgtgagaaaaacaggagttaaaagacaatatatagtcctgagacttgtgtattcctggaacattaccagaatgtgatgtttgaacataatgcgaaagataagatttatgaaaatgaagatgggacgttttttataggtttagtgcgaaagaagacgtatgcaacatatgaagaagctgttgatactgtctgtgaacgaaaggtgctacaagagattatgggacataagacaattgccattacaatgcaagtatataatcatgttttagagggacgagcagaagcagaaatgcaacgaatttcatcagcattagtggtatgatttttaacccaattttaacccaatttataacccaattggaataaagtttataaagaattataaagagttatatgtaaagaatcctgtaaatatagcgatataacgagatataaagatttacatagcgaaacccttcttacaacaagagagaaatcgttactgtagaaaactaattaaaaaaggctatagtacaggagttaggcgtattgcttagctccttttctttttcctaattttcctaaatctgctaaatattattgatttttacggtcatgtctagtagaattggtttagtaatgctgggaggtaacagtatgaaagaaataacaaaagttgttgtcgatgcaatgggcggagacaacgcaccgcatgagatcatcaaaggtgcggtcgaggcggtcgggaagtcagatgcgatccatgtgatcctggtcggaaaagaagatgtcatcaatcaggaactttccgggtacacatataataaagaacagatttcggttgttcatacatcggaagtaattgagacagcagaaccgccggttatggcgatccgcagaaagaaagactcatccattgtggtaggtcttaagatggtgaaggataaagaagctgacgcttttgtttcagcaggaagttccggtgcggttcttgccgggggacagcttctggttggacgtatcaaaggggtggaaagaccaccgcttgcaccgctgatcccgacagaaaaaggattctccattttgatcgactgtggggcgaatgtagatgcaagaccttcacatctggtgcagtttgccaagatgggttcgatctatatggaacatattatgggagtcaagaatccgaaggttgcgatcgtcaatatcggagctgaggaagaaaagggtaatgccctggtcaaggagacttttcctatgctgaaagaatgtaaggatattaactttaccggaagcatcgaagcgagagaaatccctcatggacaggcagatgttatcgtctgtgaagcatttaccggcaacgtgatcctgaaactctatgaaggagtagcatcggttcttgtaagcaagattaaaggtggtatgaagcagaatctccgcggcatgatcggtggacttctggttaagccggtgctgaaaaagactatgaaggattttgacgcaagtgagtacggtggagcaccactgcttggactcaccggtctggtagtaaagacacacggcagttccaaggcaaaagaagtctgcaattcaattttgcagtgcgtaaccttcaaagaagaaggaatcaatgaaaagatcaaagaatgtattcaggcggaagaaaaatccgcacaggaataagctcagaaaggattaagaattatggaatttgaaaaactgaaagacattattgttgatgtgatgggatgtaacccggatgaaattacgatggacactacatttgtagatgatctgggagctgattcgcttgatattttccagattattatgggaattgaagatgcatttgatatcgaaattgaaaatgaagatgcagaaaagatcgcaacagtaggtgatgctgtagaacagatcaagaacgctgttaactagggaaaatgattacaggggacatccccatttttggggagtgtccttttttaaaattggaggagcaatcatgagcagaaatgtaaaggaactggaagaaaaaatcggctacaatttcaaggacagccatttgctcagacatgctgtgacgcacagctcttatgtgaatgaaaagcatatgaagaaggcagactgtaatgaacgtctggaattccttggagatgctgttctggaactgatttcaagcgaatatctttttttcgagaaccagacaatgccggaaggagaactgactaagttaagagcaagcatggtatgcgagaaggcacttgcattttgtgcgcgggatctggaacttggaagttatctgttgcttgggaaaggtgaggacgcgaccggtggaagattcagagagtctattacctcggatgcattggaagcactgattggtgcgatttatctggatggtggttttgctaatgcgaaagagtttattttaaaatatattttaaacgacctggaagggaaacggctcttttatgatagcaagactatcctgcaggaaatggtacagggcggtcaggaaaaaggaattgtctaccagctggtaggagaagagggaccggaccacaataaatccttccgtgtagaggttgtgatcggcggagaagcctttggatgtggtatcggaagaaccaaaaaggctgccgaacaggaagcggcttatcaggcaatcctgaagctgaaagaaggaaaggtacagtaggtgaggcatgtatttaaaaagtattgaagtacagggattcaagtcttttgcaaataagattgtctttgaatttcataacgggatcaccggaatcgtcggaccgaacggaagtgggaaaagtaacgtggcggatgccgtccgctgggtactcggagagcagaaggtgaagcagctccgtggaggtacgatgcaggatgttattttttccggtacggaaaaccggaaacccctcagctacgcatcggttgcgatcacactggataattcagatcacaaactcccggtggagtttgaagaggttaaagtcacaagaaagttgtaccgttcgggggaaagtgaatacctgatcaacggcagtgtctgcaggctcaaagatatcaatgagatgttttatgatacaggtatcggaaaagaaggatattcgatcatcggacagggacagattgacaagatcctgagcggtaagccggaagagagacgagagctttttgatgaggcggccgggattgtcaaatttaagcgccgtaaggcgttatctcttcgcaaactggaagaagagcagagcaatctggtccgtgtcaatgatattttgggagagttggaaaagcagtttggtccgcttcagaaacagtcggagacagcgaaggaatatctgaaaaagagagaagaactgaagcattatgacatcaatatgttcctggtggagatgaaacgtctgaaggggcagatccgggaaaacgatgagaagctgaagattgcgcagaatgaactcactgaagccggtaaaaagcatgaagatatgaaggcacagtatgagaagatcgagcaggaagtagatgagatcgacgccggaatcgagcatgcaaaaagccagagaaatgagacaacacttctgaagcagcagttggaaaaccaaatcgagcttttaaaagagcagatcaacagtgtccgtatgaatgatgaacactatgaaaaacgcgcaaacgatattcaggcagagcttgcaaaccgtgaaaggcagaaatccgaactggaagaagaaaaagcagagatcgacagacatcttgcagcagcatctgagagacaaaagcaggcaggagaggagctgactgccctgcagagccggattgcagagatgacagtggagattgaaaagaatcagaacgatatccgtgagcttctgaataaccgtgcatccacgaaggcaaagctgcagcattatgaaacgacgcttgaacagatcaaggtacgccgggcactgctttacaaacgtctggtagaagcggagagtgatgtacagaggcaacaggaacttgccgcgcagtatacggaagaactgaaggcagtatcagggaagatcacggattctgtagaacagatcaaaaactatgaaacagagattgccggactgcaaaaagagatcggacaggcaaatgaaaacctgcgaaacaggcagaatgcttatcacagggagtactctcgtctggagtctctgaggaaccttacggagcgttacgatggttatgggaacagtatccgtcgtgtgatggagcagaaaagccgtgagccgaaaatcctgggggttgtggctgatctgatcaaagtagataaaaaatatgagactgcggtggagatcgcacttggaggcagtatccagaatatcgttactgcagacgaagagactgcaaaaaaaatgattggttatctgaagcagaaccggtatggacgtgcaactttccttccattgacagcgattcatgggggacagggatttgccagggcagaagcccttcgcgagccgggtgtgatcggcacggcggacaagctggtaacggtagaagataaatttacatctcttgcagagcatcttcttggaagaactcttgtggcagacaacattgataccgggatccgtctggcaagaaagtatcgtcagtccctgcgtatcgttacgctggaaggagatctgatcaatcctggcggagcaatgagtggtggagcatttaagaattccagtaatctgctcagcagaagacgtgagattgaagaactggaaaagacggttgcgcgtctgaaaacagaactccagaaatcggaagcagaagttgcggccgcaaaggagaagcggacggcgctgtatgcaaaggtggaagaaatccagcaggagttgcagaatgactatgtggttcaaaatactgcgaagatgaatctggaccaggtaaaaagccgtcaaaatgtgaccagagaaaattcagaaggaatttatgcggagcgcaagaaactggaagaacaggttcatgagatcgaggaaaacgaagaatcgatcaaaatggagctggagaccagccagcaactggaggacgagctgacacgccagatggaaagctcacagaagtggctggaaaaagagcgtgaggcagaagcggcagaagtgcgcaaaaatgaaaatattcacctcagttttgctgcattggagcagaaaaaagattttatcgaggagaattttgtccgtatccgggaagagatgggaaaattccaggaagagcttgccactttaaatgcaagcaaaggagagaatcacggtgaaatagagcaaaaggaagcacagattaccgagattcggcagacgatagagaattcaaaggaattatttgaggaaatcaacaaagagatcgaagaatcgcagaaaaagcgggaagaactgaatcagaagcataaggcattcctgaaaaagcgagaagatctggcagcccatatggcagagcttgataaagaatccttccggcttaccagcaagaaagaaggctacgaggaagctttggaaaagcagatcaattatatgtgggaagagtacgaactgacgtataatcatgcactggaaatccgggatgagagtctgacagatcctgccgagatgcgaaggcggatccaggaattaaagacggagatccggaaactcggatcggtgaacgtcaatgcgatcgaagattttaaaaatctttccgagcggtatgaatttatgaaaacgcagcatgatgatttggtagaggcagaagcaacgctcaagaagatcattgaagagctggacgaggcgatgcgcaagcagtttactgagcagtttgcgaagatcagccaggagtttaatcaggtgtttaaacaactgttcggtggtggaaaaggaactctggaactgatggatgatgaggatgtgctggaagccggaatccggatcattgcgcagccgccgggtaaaaaacttcagaatatgatgcagctttccggtggagaaaaggcgttgacggcgatttcgctgctgtttgcaatccagaatctgaaaccttccccgttttgtctgctggatgagatcgaggcggcactggatgattctaatgtcacgagatttgcacagtatttgcacaagctgacgaaaaatacacagtttatcgtcattacacaccgtcgcggtacgatgacagcggcagaccggctgtatgggatcactatgcaggaaaaaggggtatcaacgctggtatctgtggatcttctggaagatgagcttacaaagtagtggataggaggatatgatggcagaagaaaaaatgggattttttaagcgtctggtagcaggacttaacaagacgcgcgataatatcgtgtctggaatggacagtatttttcatggattttcaaagatagatgaggacttttatgaggaactggaagaggttctgatcatgggagatctgggggtaaaagcaacttacgcgattcttgatgatcttcgtaaaaaagtaaaagaacagcatatcaaagagccgattgagtgcagacagctcctgatcgacagtatcaaagagcagatggatgtaggcgagacagcttatgaatttgaaaaccagacttctgttgttctggtgatcggagtaaatggagtcggaaagacgactactatcggaaaacttgccggtaagatgagaggtcagggcaagaaagttgtgcttgctgcagcagatactttccgtgcagctgcgggcgatcaattaaaggaatgggcacatcgttcggatgcagatctgatcggcggacaggaaggtgcagatccggcagccatcgtttatgatgcggtagcggctgcaaaagcgagaaaggcagatatccttctggtggatacagccggaagacttcacaataaaaagaacctgatggaggaactgaagaagattaaccgtgtgctggaaagagaatatccggaagcatacagggaaactttggtcgttctggatgcaacgaccggacagaatgcactttcacaggcaaaggaattcagtgatgttgcggatattacaggaattatcctgactaagatggatggaacggccaaaggtggaattgcagttgcaattcaggcagagcttggaattcctgttaaatatataggtgtcggtgagacaatcgatgatctgcagaaattcgattccgacgaatttgtacaggcattatttacaacagaagaaaagaaggaagaaggagaagaataataatatgctgacattggaaaaatttgaagaagcaagcgagatcgtaaaacgtgtgacacgtccgacaaagcttatctacagtgagtatctcagtagccagaccggggggaaggtctatttgaaaccggaaaatatgcagtacacaggtgcatacaaattaagaggagcttattacaagatcagcacactttctgaggaagatcgtgcaaaaggtctgatcacagcttcagcaggaaaccatgcgcagggtgtggcatatgcggcaaaagcgtttggatgtaaggcgacgattgttatgccaactgtcactccgctgatcaaggtaaaccgtaccaagagctatggcgccgaggttgttttacacggagatgtctatgacgatgcctgtgcaaaggcctatgagcttgcagaagagtacggatatacttttgtacatccgtttgatgatctggatgtagctaccggacagggaacgattgcaatggaaattgtccaggaactcccgaccgttgattatatccttgcaccgatcgggggcggcggactgatcacaggtgtatctacacttgcgaaaatgctgaatccaaagatcaaagtgatcggtgtggaaccggcagaagcagcaagtatgactgctgcaatcgaagcaggacataccgtaacacttccaagtgccaacacgatcgcagatggtacagcagtaaaaaaagtcggggaacagaacctcccatacgtcatggaaaatgtagaccagatcgtaactgtagaagacgatgaattggtcggagcattccttgatatggtggaaaaccataaaatggtagtagaaaactccggtcttctttccgttgcagctttaaaacagctggatctgaaaggtaagaaagtagtatctatcttaagcggcgggaacatggatgttattaccatgtcttcagttgtacagcacggactgatccagagagaccgtatcttctctgtatcggtacttcttccggataaaccgggtgaactggtaaaagtggcacagacgattgcagaagagcagggaaatgtgatcaaactggaacataatcagtttgtaagtattaaccggaatgcggctgtggagcttcgtgtgacactggaagcatttggaaccgatcataagaaccggatcattgcggcattggaggcagccgggttcagaccgaagctgatcagtgcgaagttatattagaatgtttaagaggacagtcttatcccctggtgagggatgaggctgtctttttttgaaaataaggttgttaggccgggggagaaaaagaatctcttccgatccaggttgtgcaaaccattccgatgaacctctgaaggcgaaaattatgtcagcagaggcttccataatttttgagtttcatctccattgcacaaaataggattgaaagagattctttttctcgcccggccaatgaacggtattggtaaaaagggcaggactgcttcatagtgagggagaggggatagagactgcaaatgtgattgggtgcttgttaaagacgggagatatagatggaaaaatatggaaatttaaccaattagcactttaattgaatgaaatactgtgttaaagtcacgaaatgaggaaaatggggttgacatcgaaggtatagttgtatacaataatacaaaaatacaggtcagggagtgacggttatggaaaataggaaggtttatctggataagcatacaaatttattgcaacttgaggagcatatgtacccgctggtagacgtggacacaccgaatgtgttccggaacctgtttcattatgatgagattccgaagattgcgtttaatgatcgtattgtaccgcacagtatgccggatgagatctggatcacggatacgacattcagggatggacagcagtcgagagcaccctattcaacggatcagattgtaaccattttcgattatatgcacaggcttggaggttcgcaggggaagattcgtcagagtgaatttttcttatacagcaagaaagaccgtgatgccgtatataaatgtatggaaagaggttataagttcccggagatcacaagctggatccgtgcaaataaaaaggattttgagctggtaaaagatctgggaatgaaggaaaccggaattctggtaagctgttcggattatcatattttttataaactgaagatgacaagacgagaggcgatggaacattatctgtcagttatacgtgaatgtctggagaccggtgtcagtccaagatgtcatctggaagatattaccagatcggatatttatggatttgtcattccattctgtctggaactgatgcatctgatggaagaatatcagattccggtgaagatccgtgtctgtgatacaatgggatacggagtcaactatccgggggctgtgattcctcgttccattccgggtatcatttacggactcagagtacatgcaggtgtaccgagtgaactgatcgaattccacggacataatgatttttacaaggcagtcaacaattcaacaacggcctggctttatggagcatgtggtgtgaactgttccttgtttggaatcggtgaacgtaccggcaatacgccgctggaagcgatgatttttgaatatgcgcagcttcgcggaacgctggatggtatggatacaacggtgattactgaactggcagaatattatgaaaaagagattggatatcagattccgccgcgtaccccgtttgtcggaaagaatttcaatgtaacccgtgcggggatccatgcagacggactgttaaagaacgaagaaatctacaatgtgtttgataccggcaagtttctgaaccgtccaccactggttgctgtgtcaaatacttccggccttgcaggtattgcacactggataaatacatattatcacctgaaaaatgagaaacaggtagacaagaattccattttagttgtagaattgaagaagtgggttgacgcggaatatgaatccggccgtgtgaccgtactcacagatcaggaactaatccgggagattgagagaatctgtgacgaaaaggggattacaatctaacgaaattcaggagagagataaaatggaagagtattcattgagaagtcaggtttttcaaactatcagagatgacattctgaaaggtaagtatgaagaaaatgacgaactcagggaagcaacattggggaaggaacttggagttagccgtacaccggtaagagaggcacttagacagctggaactggagggactggtgaacattatcccaaataaaggagcttatgttaccggtatttccgataaggatgtacatgatatttatatgattcgttccatgctggaaggattatgcgtccgttgggcaacagaacatattacacaggagcagctggaagaactggatgagatcattcttttatccgagtatcatatggataaaggacattccgatcagctgacagagctggatggaagattccatcagattctgtatgaggcatcacagagcaggattctggatcatgtgctttcagattttcacaaatatgtacagcttgcaagaaggacttccgttaagacagaagagcgtgcgatcaagtcgattggtgagcataacgagatcctgaatgccatcaaggcgaaggatgcggaaaaagccggcgatctggcaacgatccatattatgcatgttatggagaacctgcatatcgaagaagaatagccaaaaaggagacgaagttatgagtaaaattcagatgacgacaccgattgttgagatggacggagatgagatgaccagaattctctggaagatgataaaagatgatcttcttctgccgtatatcgatcttaagacagattattatgatcttggattagaacaccgcaatgagacagatgaccaagttacagttgattcggctaatgcaacaaagaagtacaaagtagcagtcaaatgtgcgaccattacaccgaatgcggcaagagtaaaagaatatgaactcaaagagatgtggaagagtccgaacggaacaatccgtgcgattctggatggaacggtatttcgtgctccgatcgtggtaaaaggaattgaaccatgtgtaaagaactggaagaagccgatcacgattgcccgtcatgcttatggggatgtatataaaggaaccgagatgaagattccgggacctggaaaggcagagctggtctacacggcacctgacggaacagagacaagagagctgatccataatttcgatggagcaggtattatccagggaatgcacaatatcaatgcatcgattgaaagttttgcaagaagctgttttagttatgcactggatacaaagcaggatctttggtttgcaacaaaagataccatttcaaaaaaatatgaccatactttcaaagatattttccaggagatctttgatgcggagtataagaacctttttgatgaagcgggaattgaatttttctacacactgatcgatgatgcggtagcccgtgtaatgaaatcagagggtggttatatctgggcatgtaagaattatgacggggatgtgatgagtgatatggtttcctcagcatttggttcacttgccatgatgacatctgtactggtatcaccggaaggcttttatgaatatgaagctgcacatggaacagtacagcgtcattattataaacatctgaaaggggaagagacttcaacaaactctgttgcaacaatttttgcatggacaggagctttgcgcaagagaggagaactggatgggaaccaggaactgatggattttgcagaccgtttggaaaaagcaacgattgatacgattgaagagggttatatgacaaaggatctggcaatgattacaactcttccggaggtacatgtactgaacagtgaagggtttattaaagcgattgcagaaagattataaaaagagcagggaatgcatgaagggcgtatctctgacaggaaaatgggaagaactggcttattcagccagttcttcccatttttcatagagttcttcgagttctgcttcgtttgctgctttttcttttgccagttcctggcatttaacagaattcgtatagacttcttcctgcatcatcagttcatcaattttgccattacgtgtttccagaacaccgatacgttcttctgttttcttcaggtcgttctgccttttacggagacgtgcctgttcttctttctgttcctgccagcttagtttggattcggaaacctgcgccggtgcgtcttcggaagcagctgtggaaacagccggggtcagaagatcttttttctccagataataatcatagttgccgatataatttacaaaggtattgccggtcagttccagaatacgggtggcagtctggttgatgaaataacggtcgtgggatacataaagtatcgtaccggtataatcgttcagagcccgctcaagaatttccttggaagtgatgtccagatgattggtcggctcatcgaggatcagaaaatttgcattggagagcatcagctttgccagagatacacgtcccctttcaccaccacttaaatcaccgatcagcttgaaaacatcatctccggtaaaaagaaaagccgcaagcatgttccggatctgtgtgttggtaagtgtcggataatcatcggaaatttcttcaaagatcgtcttatccatatgaaggacgtggtgttcctgatcgtagtaaccaatctccacattggcacccagtgtaaaggaaccgctgtctgcctggatcacattgttcagaatcttgagaagtgtagttttcccggttccgttgtcgccaatgatagctatatgttccccacgcttgatctcgaaactgatatcggtgaaaagtgtctgtggcggaaaggctttgcttaatcctttgacagaaaggacatcattgccactgacatgggaaggctccagcttcagatggatgtcagtgttgatctccatcggtttgtctacaagcgtcatcttgtccaacattttttcccgactttcggcacgcttgatggatttctcacggttaaatgaacggagcttttcgatcacggcttcttgatgtttgatctcacgctgctgattcaagtattcttttaatctggcttctctgagctgttcttttttgacagcaaaatcagaataattgcccatataagtatgaagctgtccctgctcgacttcaattacctttgtaaccacacggttcaggaaatagcggtcgtgggatacgataagaacagcacccggataattcagaagataggtttccagccatgcgatggagttcatatccaggtggtttgttggttcatccagaagcaggacgtcaggcttggtaagaaggagtttgccaagagatacacgggtcttctgaccaccggataaagaatctacaggtttagtaaattcttcttctgtaaatccgagaccttttagaacgccggtaagctcacttttataagcgtaaccgtctgcgtgttcaaatgcagaagtcagtctctgataagtggcaagacgtgcttcaagagcatctccggaaagagacggaagctctatctcgattgtacggatctgcttttccatctcaatgacttcggcttttgccgtgcggacttcttcgtaaatggtattgccgctttccatctcctgatgctgtgcaaggtagccgagagttttgcctttggtaagaacaaccgtccctgcatcgggagaaagctgtcctacgatcatcttgaggatcgtggatttgccggctccgttaagacctacaagagcagctttttcatggttctctatatgaaaggatccgtcttttacgatgacctgatccccaaaactttttgacagattatgacatgccagtatcatttttatatcctcctgttaaagtggcaattatgttactgctcacagtaacataattatagctgaaatacgacaaaaaacaactataaaatttgactttttcactagattcttatataattaaaaataatgagtcaaaaaacaggaaggtggaagtgaaagtggcatcaagagaaatatctcaggcagtaataaggagacttccgcggtattatcgttatttaggggaactactggagagcggagtcgaacggatatcatccaatgaattaagtaaaagaatgaaagtaactgcttcacagatccgtcaggatctgaataattttggtggatttggacagcagggatatggctataatgtaaagtatctttatacagagataggtaagatccttggactgaacgagaaacataaattcgttatcattggagcaggaaatcttggacaggcactggcgaactatgcagcatttgaaaatcggggatttgttttaaaagggctgtttgacgtaaacccaaggcttgccggattgacgatccgtggagttgagatccgtatgatggatgaattgaaggattttgtgaaagaaaacgatattgagatcggggttcttacgattccgaagacaaaagcagtagaggttgccaatctcctggtagataatggagttaaggctatctggaattttgcgcatacagatctgaatctgccggataatattattgtggagaatgttcatttgtctgaaagtttgatgagattatcttataatatcaccagatacaatgaagaacatgaaggaaagtaggcaaagcagaccagaaggcagaggtgcaggaaagttttttcctgcacctttttgaaaatcaaatgtatgggagaccggatatgaaagaaatactgacagcagatcagatgagaagatcggatcagagaatgatacagaagatgcaggtcccgtcccttgtcctgatggaacgggcggcacttcagtgtgtggctgcgatgaaagcagaagacatagatttgtcgaaagcactggtcgtgtgtggaagtggcaataacggtggtgacggattcgcaattgcaaggatgctcgtagaagaagggaatcatccagatgtagtattggtcggaaattatgaccatcgtagtgaagaaacaaaaatccagatgaaaattctggaaaatctgggaatatctgtaggaaacagtttgccacagaaagaatatagtgttattatagatgccgtattcggtattggcctatcccgtgaaataaaaggcagatatgcagaggtgattgatcagatgaatcggatgactgcctgtaaggtggcagtcgacactccttcagggatccgttcggatgatggaaaagtgcttggaacggcatttaaagcagatcttacagtgacctttgcgtttcagaagatgggacagatcctatatccgggatgtgagtatacaggaaagcttgttacagcgccgatcggaattaccagaccggagttttttgcggaagaagaaatctgcatggcacttgaaaaatccgatgtgccggcaatgctgccgcaaaggaaaccggattctaataaaggaacttatggaaaggttctgatgattaccggaagcaaaggaatgtccggtgcagcatatttaagtgccagggcagcatatctttcgggagcaggtcttgtccggatttatacggaggaaagtaaccgggcaatcttacaggaacttttaccggaggcggtaatgacgacctattctctggatgagacagaatcatttgaagaacttccggatttgctggaatgggcggatgtgctctgtattggatgcggactcggtatgggaccgcattcggaggaattactgaaaaaggtgcttgagaataataaaaccccggctgttattgatgcggacggactgaaccttctggcaaagaccgatgagtgggggatcgaacagattcggatgaatccttccggatatgtacttactccacatatgaaagaaatgtccagactgaccggatacagcgtacaggaattaaaagacaacagaagagagctattaaggaaatatacagaaaaagtccatgctgtctgtgtactgaaagacagcaggacacttgtgaaagcgccagagggaaggcttatgatcaataccaccggtaatgcggcaatggcaaaggccggatcgggagatgtgcttgcgggaatgatcaccggacttatggcacagcatatgagaccggatgatgccgctgtgcttggcgtttatctgcatgggctgtgcggagattatgccagaaaagaacttggctcttacagtgtgcttgcgggtgatctcttgaaaatgctcggcagaacacttaaggaattggaggatatgacagaatgaagaaatacagcagactgcgtgcggtgatcgatctggatgcggtgatgtataacatggaaatgatgcatgcaaatatagaaaaaggaaccaagatggtcgtggtcatcaagacagatggttatggtcatggagcggtgccgatttcaagaatgctggaagatgtggactatgtctggggctatgcggtcgcaactctggatgagggtgttgtgctcagaaaagccggcattcagaagccgattctttgcctgggatgtattttcccggaccagctggaagagatgatccgtcatgagatccgcatgacaacctacagctatgagcttgcgaagcttgcggatgagaccgcataccgtatggggaagaaggcatatctgcacattaagatcgatacaggaatgtcaagacttggctttccggtagcgaaagaaagtgtagaggagatccttaagatcggcagacttgtttatacggattgcgaaggaatgtttacccatttttcaaaggcagatgagacggataagaccacgacactggaacagatccgtgcttttttgtggatgaaagaacatcttgcagcagaaggtatggaatttacttattatcactgtgcaaacagtgcaagtatcattgatatgccaaagcttggaatgaatctggagagagccgggatttctacctatggactgtatccgtcagatgaagtcaataaggaggcagttccgctccggccggcaatggagctgatcgcgcatgtgacttatgtgaaatggattgaaaagggtacggaagtcagctacggaggcacctttgttgccccgaaaaggatgcagattgccacgatcccgacgggatatggagacggatacccacgaagtctttccaacaaaggatatgttctgatccatggtcagaaggcaccgatccttggcagagtctgtatggatcagtttatggtagatgtgaccggaattccggatgtgaaatttggtgacagggcaacactggtcggccacgatggggatgcttatctttcaatagatgagcttgccggtctgagcggtagatttaactatgaatttatctgtgatatcaataaacgtgttccgcgggaatatctgcgtgacggaaaagttgtagagcaggtcgattatttctaaaatgcggggatgcacttcgaaagagatatgaatacagcaggagaaagctggcaataatgaaagtatcttgataagcggagtgtgaaagaagtgcagatcaggcgtggagatatttattatgcggatttaagtccggtagtcggttcggagcagggcggtgtgcgtccggttcttgtcatccagaatgatgtcgggaaccggcacagtccgaccgttatctgtgccgcgatcacttcaaggatgaataaagcgaagctgccgacacatgtggaaatcgatgcaaaaaggtacagaatcgtcaaggattctgttgtccttctggagcagattcggactatcgataaacagagactgaaggattacgtgtgccgggtagacaaagagcttatgagaaaagtcgatgaagcgctgtgcgtcagcctgatgcttcatacataaaagaggagaagtatggaaagcaatggaaacggaaggtaatttacttcagaaaatgaaaaatgtattttctgacaatgaagataaagagaaaattgcagaagaaatcattgaaaaagtactggaaggctatgaaaaaggtgttctgacaagacgtgagatgaagatgatcaccaacatttttgaatatatggattcggatgcaaaagatatcatgacgcaccggaaaaatatcgtagcactggatggagaggaatctctggaaaaagcacttacctttatgctggaggagaacaaatccagattcccggtttatgaagaagatattgacaacattgtggggattcttcatatccgggatgcgatgcagagctacctggacggtccggcaaggaaaaaaccagtgcatgatctgaaggatgccatccgtccggcaggatttatcccggaaacaaaggcgattgacaaactgtttcaacagatgcagcaggacaagagccatatggtgatcgtgctggatgagtatggacagacatcagggatcgtaacgatggaagatattgtagaagaaatcgttggaaatatccaggatgagtatgatgaggaagaagagctgatcatcaaacaggcagatggtacatatatcgtggatggtatgacacagctggaggatctggaagagcttctgggaatcagtttcaacgaagaagattacgatacgatcaatggttatctgatcgactgcctggacagaattccttcggaagatgaagaatgtcaggtggaattcggaggctatctgttccatgtattgtcagttgataataatacaatacgcaaagtccttgtcagtaggacaaaaaagtgataaaatagtacaattgagaatagtaaaaatactgaagagaggtaaaaagtaatgtcaggacattcaaaatttgcgaatatcaagcataaaaaagaaaaaaacgacgcagcaaaaggaaaagtattcacgaagatcggtcgtgaaatcgctgtagcagtcaaagaaggaggcggagctgatccggctaacaacagcagactccgtgatgcgattgcaaaggcaaaagcaaataatatgccaaatgacaatattgacagaagtatcaaaaaagcagccggagacggagatgctaacaactacgaacacatcgtatacgaaggatacggaccgaacggaactgcaatcatcgttgatgcacttactgataaccgtaaccgtactgcttctaatgtaagaagcgctttcacaaagggaaaaggaaatatcggaaccagtggatgtgtttctttcatgtttgatcagaaaggacagatcattgtcgataaagaagaatgtgaactggatgcagatgatctgatgatgcaggcactggatgcaggagcagaagatttttcggaagaagaggacagctttgaaattcttacagatccgaatgatttcagtgaggttcgtcttgctctggaagaagcgggtattccgatggcaagcgcagaagttacaatgattccacagacatgggtaactttggacaacgaagaagatatcaagaacattcagaagacgcttgatcttcttgaagatgatgatgatgtacaggaagtatatcataactgggaagaagcataggatcgattccgggaggaacctgaatgaatcagagtatacaggatggattgaatgacctttttgaccagattattccgatttccggagatttcaataaaaagacttatgcggattcgtttaaaaatgcatacgagaagtataagtcactttttactgagattgcacaggaatgcgagaattcggaagacagacaggaagagattgaagagattgctgctgttctgccggatagaatgcgggaagtactggatcaggaaatttcaaaaagaaaaaaagaaaatgtacttatgaaatataatctgggcatggttacgtatgtgatcccgatgttccgttatggcagaatggatgcttgtgaagagattgtagactgcatgatcgaacgctggaatgatcatgatctggaactaaagatcagtaaatcggaattcgagcagatccagggaggcttcaaatcacgtctctgctatattactacagccgtatgtgcaagccttggcaaaccggatgactgttacgaactgaatctgatgagaagatacagagatgaatatctggtgaatcagaaaggcggcgaagaaattgttgccgagtattacgatattgctccgacaatcgtaaaccggatcaaccggatggaaaattcagaagatgtatatgcagatatctggtgccgttatcttcacccatgtgtttccatgatcgaatccgataatctggaggcatgccgcaagatttatacggatatggtatatagcctgcgcaggaaatatttattttcataatgtttaaatcaaagagaatgtgccgagtcacattctcttttgcatatacagtgaatcaggtacagatttgtgtcggtacaagaatctgcgattcatttctgtggcgaaaatcctgcatattttcataagcattgtccatactaagctaaaaagaacggaggaatgcggcaatgaaaatacaggaagaaacggatgtaaaagaataccagatacgcaagaaaaagagcagggaacagactgtaaaaaatatggaaaataaagaaaaggcagtcagagagacagagctggagaccacaaaggaagaagatgaacatgttaaagaaatgggaatgctttcgcttgatcgacgtcggaatcatcagatcgagctactcacgatcatcggcgaagtagaagggcatgagacggtttccggcagtacaaaggcaaccaagtatgagcacctgcttccaaagctggcacagattgagaacagtgttcagactgatggtgtgctgattctcttaaatacattgggcggagatgtggaggcgggacttgcgattgcggaaatgatcgcgtccttaagcaaaccgacagtatctctggtacttggagggtgtcattctatcggtggccctcttgctgtgtcggcagattattcttttattgttccaagtgggacgatgatcattcacccggtgcggacaagcggaatgttcatcggtgtggcacaaagcctgcggaatattgaaaagacgcaggatcggatcaccggattccttgcagagcattccggaatgtcacaggagcggattgaagaactgatgctggattccacacagcttgtcaaagatgtggggacaatgctggaaggaaaacgtgcagtggaggaaggactcattgacgaagttggcggaataagagatgcattaaataaattgcatgaaatgattgatgaaaaaatggaaaatactgataaaaattatgagatgacataaggcgaagaggatgctataataaaatagtatgtacaagtatacacttttgatgactgattccggatactatatctggggagagaggagaaggaatcggtcatttgattacaagataaagagtataaatacaagggggaagtttgatggcttcaaagacaacaggaacaaagaaaaatgcaaagcagagcacggcgaaaaagcggcagcctacgaagaagacaagtgcaaagtctgcaaaatctgcgaagacaaccagaaagaataccacatcaaaagctgtgccgcaggaagaatcatttcttgcaacggagattctgatctgggtgacacttgcggtagggattctgctcacaatcagcaatttcggacttgcaggtgcatttggaagaaagattgcagcactgcagcagggaatgatgggttggatggcgtatgtattcccactgcttttattttgtggagtcgcgtttgtggtttccaataaaggaaacaggatcgcatatattaagactgttgcaggcgttgtattactggttcagtgctgtgtgctctttgaactgattgatgaaaaaggcggatctgtcggaaaggcaattgcggtcagactggtgccggcaatcggtaaagttggtacatatgttgtcgtgatcattttaatggtgatctgtgtagtccttatcacagaaaagtctattctaaaaggaatgaagatcggcggggaaaaagcgtatgaccgtgccagagaggacatgcagaagcgtaaagaagaggctgaggaacgcagggcaagacgggaagctatgcgtgttgattatcaggtaagcggcgtttcctttaattcgacagttggaggaaaagagaacgaggcagaaaaaacagaagaaaaagccggaaaagaagcaaaggaaagcacagaaaagaaagctaccagacgcagccggaaggatatgagcagcgtgcttgccggtgcagaagaagcggctgcaaagcacattatggaacagactgggaaaattgcactggatgatgtagtgatcaatcgtgcgatgcccctttccgctacagagctgatcccggatccggaaccggttccccttgagccggtgaaagaaaaactcccgaagttcttaaaaggagcgatgcaggaagcagaaaaaaagacggagtccggtaaagatatacagacagatgtggctgaagaaaatttatcagcggtgcagacagaagacggaataaaaagacaggtctccggaaattcaaaagttaaggcagatatcccaaaagaggtggctgctgttgcagatacgattgcaaaaagtgagaaaccggtcagggaataccgctttccacctcttagtctgttgaagcatggaagtaaaacctccggagattcggatgcgcatctgcgggagacagcagcaaagctccagaagacacttcaaaccttcggtgtgaatgttacaatcactaatatcagctgcggaccttctgtcacacgctatgagttacagcctgagatgggggtgaaagtcagcaagatcgtaggacttgcggatgacatcaagctgaacctggcggcggctgatatccgtattgaggcaccgattccaggaaaagcagcggtcggtattgaagttccgaataaggaaaatactgcagttatgctgcgtgatcttctggaatcagatgaatttaagaaaagtagatcacggatcgcatttgcgacaggtcgtgacatttcaggtaaagtggtggtatcagatatcgcaaagatgccgcatctgcttgtcgcaggagctaccggatccggtaaatctgtctgtatcaatacgatcattatgagtattatctacaaagcaaaaccggaggatgtgaagctgatcatggtagatccaaaggtggtggaattaagtgtatataatggaattccacatctgatgatcccggttgtaacggatccgaagaaggcagcaggagctttgaactgggcggttgcagaaatgaacagacgttatcagctttttgccgagtataatgtccgtgatctgaaaggttacaatgataaagtcgagaacattaaagatattgatgatccgaataaagcacagaaacttccacagattgtaatcatcgtagacgaacttgcagacctgatgatggttgcacctggagaagtagaagaggcaatctgccgtctggcacagcttgcgcgtgcggcaggacttcatctggttcttgcaacgcagagaccatcggttaatgtcattaccggtctgattaaggcgaatatgccatcaagaatagcattttctgtatcatccggtgtggattcccgtaccatcattgatatgaatggcgcggagaagctgctgggaaaaggcgatatgttgttctatccggctggctatcagaagccggtacgtgttcagggggcttttgtttctgataaagaagtccaggcagtggttgatttcctaaaagagaacagcggaggcgcagcctacagtgaagagatccagaagcaggtgaatagtaatcagaatgtatctgcgggaggagcatcttccgaggacgacaaagatgtctactttgtagatgcaggaaagtttatcattgaaaaagacaaagcatcgatcggaatgctccaacgggtgtttaagatcgggtttaaccgtgcggcgcggattatggatcagcttgccgaggcgggagtcgtaggagaagaagaaggtaccaaaccaagaaaagtactgatgtctatggaacagtttgagcaatacatagaagaatcagtttaagaaacgcagaagaaaaaagggaggatataattatgaaaacagacattcagatcgcacaggaggcagagatgctccatattcgcgaggttgcagcaaaggttggaattgaagaggaagaccttgagttttacggcaagtataaggcaaaattatcggatgaactgatggaaagagtaaaagacagaccagatggaaagctggtacttgttactgcaatcaatccgactccggcgggagaggggaagacgacgattaccgttggacttggagaggcaatggcaaagctcggtaaaaaagctctgatcgctctgcgcgagccatcgctcggaccttgctttggaattaaaggcggtgctgccggtggcggttatgcacaggttgtaccgatggaagatctgaatcttcattttaccggagattttcatgcgatcacatcggcaaataacctgcttgcagctcttcttgacaaccatatccagcagggaaatgctcttggaatcgatccgagacaggttgtgtggaaacggtgtgtagatatgaatgaccgtgtactgcgtaatgtagtagttggtcttggaaataaaatggacggaatggtaagagaggatcattttgtgatcacggttgcgtccgaaattatggcaattttatgtctggcagatgatctggaagatctgaaaaaacgtcttggcagaatcattgttgcctatacattttccggagaaccggttacagctgaccagcttcatgcaaccggtgcaatgacagcactgttaaaggatgcgatcaagccgaatattatccagactctggaacatacaccggcactggtacacggtggcccgttcgcaaatattgcacatggctgcaacagtgtacgtgcaaccaagatggcgcttaagctgagtgatatcacgatcacagaagcgggattcggtgcggatctgggtgcagagaagtttatggatatcaagtgccgtatggcgggactgaaaccggacgcagtagttctggttgcaacggtacgtgcattaaaatacaatggtggcgtgccaaaagacgaactgaacgaagaaaatctggatgctcttgcaaaaggaattgtaaatcttgaaaagcatattgagaacctgcagaaattcggcgttccagttgtggttaccttgaattcatttgtcagtgatactgaagcagaatacgaatttatccgtaagttctgcgaagacagaggctgcgaatttgcccttgcagaagtatggggtaaaggcggagacggcggaaaagagctggcagagaaagtattacagactctggagacaaaagaaagccattatcatccgatttacagtgatgagttatcaattgcagagaagatcgagacaatctgcaaagagatttacggagcaaagagtgttgtatatgaacctgctgcaaagaaacagcttgcacgaattgaatcaatgggctttggcaagttcccggtatgtatggcaaagaaccagtattctctgtccgatgatgcgaagcttcttggacgtccggagaactttgatatccatatccgtgaagtctatgtaaatgcaggagcaggatttgttgttgctcttaccggagcaatcatgaccatgccgggtcttccgaaagtacctgcagcaaatggaattgatgtagaagacggtaaaattaccggattgttctaaaagaagtatgataccagaaggagacgaaagacaatgaaatgtatgcactgtggagcagatttgcctgaagatcagttgatctgtcctagctgcggcagggaaatacagatcgtgcctgattataacccacttgatgatatgctgactgctcagttaaaaggaggcattacacagacaatgtcgcttcatctgggtgagcaggaaaagcaagatgtcagctattctggtgcggcaaatccggtatatgaaagacgggaaagtgttggaggagagaccaggtgcgtgggaaattcgggaagtgttggtcgtcgccagcaggaaactgtgaccaggcgtggaagagatgcggtggtcagacgcagtgatgtcagaccggctaccggacgtgtgggtcaaagagaagatgcgcgggaacagacgagaagagcgtatgaagaagaacgcagattgcggcgtatgcgggcagaaaagagaaaagagcgcgccagaaaaaaacgccggaaaatgctgcttatgctactggcggggtgtattgttctggcaggactcattttcttgttttatcaaaattcatataccggaaaagtaaagaaaggataccggcttctggcagcttccgaatatgagaatgcactcactgtatttgaaaaagcagcttctggaagtccgaagaaagcagaagcttatacaggaatttcaaaggtttatattgccaaagatgatctggatcaggcagaagaagtttttgcagacgagattgcaaagcagtccggaaatgcagaaatttatcgtgcagcggtagaattttatattgataccaaacaggaagaaaaggtatcaccgcttctgaatgcatgtaccagtgatacggttcttgaagcactgaaggattatgtgtcaggtgaaccggagtttagtctggatgaaacagagacatatgatgaagtgcaggcactggaactgaccggaaaaggaaaagcaatctactatacgacagacggttcagagccgacaacttcaagtacgaaatatacggaaccgatcaagatcggtgaaggtgagacgacggtgaaagcaatttctgttaataagaaaggaattccaagcctgacagaaagtaaaacttataaagttgagttcccgattgcagatgcgccggcggtgactccatcgaccgggcagtataaccatgtccaatcaatcagtgtggttgtaccgaataagtatacggcatattacacgacggatggatcagatccggatccggaaaataattctgcgacgcaggagtataccgggccgatcgtaatgccggcgggaagtacgattttcagctttgttctgcaggaccaaaaaggcagattaagtgatgtcacaagaagaaattatgaactgaatacagattaaaacccgattataagaagagagtatgccaagccgtctgcttgtcagagcagactggtaaagcgtactctttttcgattactttcatttttgaaaaatttgcgtaaaatatgtgaaatatatcacaaatcaattattttatgaatagggtagaaataatatggtttattaaaaatgtataattgtatggaaataagtacaatttatttgtggtaaaatgttgcaaaaagcatagaattgagatacaatatgattgtcaaaaagataacatactttaagggcaaaggagtgtttgaaatgagcagatttacattaccaagagatatttaccatggaaaaggatgtcttgaagaactgaagaacctgaaaggaaaaaaagcaatcctggttgtcggaggaggctccatgaagcgtcagggattcctcgacagagctgagaactatctgaaagaagcaggaatggaagtaaagctttttgaaggtgttgagccagatccatctgttgagaccgttatgaaaggtgcagcagttatgcaggagttccagccggactggatcgtagctatgggtggcggatcaccgattgatgctgcaaaagcaatgtgggcattctatgaatatccggatgttacatttgaagatctctgtattccgttcaacttcccggaactgagaacaaaagcaaaatttgctgcaattccgtcaacatcaggaacagcaacagaagtaacagcattctccgttattaccaactatcagaccggagtaaaatacccacttgccgattttaatattacaccggacgttgcaattgtagatccggatcttgtcatgggtctcccagtaaagcaggttgcttacacaggtatggatgcactgacacatgcgatcgaagcttatgtatctaccttgaactgtccatttacagatccgcttgcactgcaggcaatcgagatggttctggattaccttccggcatcttacaaatgtgatatggtagcaagagagcagatgcattatgcacagtgtcttgcaggaatggcattctccaatgcacttcttggaatcgtacattctatggcacataagacaggtgcggcattttcaaccggacacattccgcacggatgcgcaaatgcaatttaccttccatatgtaattaagtataatgcaaaagatccggtcgctgcaaaacgttatgcagaaatcgcacgcagaatgggacttccgggtacatctgagaaagcgctgatcaacagcctgtgtgcaaagatcgatgcatttaatgtagaactgaatattccgaagacactgaaagatttcggtattgacgaagcagaattcaaagaaaaaattgcaaagatttcagaacttgcagttggtgatgcatgtacaggatccaacccacgtccgatcgatccggcagctatggaaaaacttttcaactgtacatattatggaacagaagtagatttctaaaaaagagaatatagttcttacagagacagacggcctcgatactgaccgtctgtctcattttatatccggtcagcaggtacaaattcgtgccggcacaagatttaatacggttgaaaaatttggtaaccggaagaattttggcagatttatagaagaaatattagtacttatagataaaaaagatagttatatttatgacataaataattttttaacaaattaaaaagaaatacttgctatttactttgcaataatttatcataaagagagtaaatattttaggaggcaatgcaatgtacaagataagaaaagctgaaaaactggctgataagatttatcttatggatgtagaagcaccacgtgtggcaaagcactgtgagccaggacagttcgtaattgtcaagatggatgacaagggggaaagaattccgctgacaatctgcgattatgacagagaagaaggaacaattaccatcgtattccagacagtaggagcatctactgagaagatggcacaattaaaagcaggagactctttcagagatttcacaggaccactcggatgtccatctgaactgatttcagaagatattgagagtctgaagaataaaaagatcttatttgtagccggcggtgttggtgcagcccctgtatacccgcaggttaaatggatgcacgcgcatgggatcgatgtagatgttatcgttggttctaagacaaaagatatgctgattctcgaaaaagagatggaagctgttgcaggaaattattacccatgtacagatgacggtacatacggacatgcaggtatggtaacaacaaagatcgaagcacttgttgcagaaggtaacaagtatgatgtctgtgttgcaatcggaccgatgatcatgatgaaattcgtttgtctgctcacaaagaaactcgaaatcccgactatcgtcagcatgaacccgatcatggtagacggaacaggtatgtgtggcgcatgccgtctccacgtaggcgatgaaatcaaatttgcatgtgtagacggaccggaatttgacggacatctcgttaactttgatgaagcaatgaagagacagcagatgtataagactcaggaaggcagagctatgctgaaattacaggaaggtgacacacatcacggtggatgcggtcattgcggaggtgacgaataatggcagacgtattaaagaaagtacctgtaagagaacaggatccgaaggtacgtgcaacaaattttgaagaagtatgttatggatataatcaggaagaggcaatggaagaagcaagccgttgcatcaactgtaagaatgctaaatgtattcagggatgcccggtaggaatcaatattcctgcattcgttcatgaagtaaaagaaggcaatatcgaagaagcatataagattatcggacagtcttctgcacttcctgctgtttgtggacgtgtatgtcctcaggaatcacagtgcgaaggaaaatgtatccgtggtatcaaaggagaatctatttctatcggtaagctggaaagattcgttgctgattacgctctggagcatgacatcaaaccggttggagctgacaagaagaacggacacaaagttgccgttatcggttcaggccctgcaggacttacctgtgcaggcgaccttgcaaagcttggctatgatgtaactgtatttgaagcacttcatgaactcggtggagtacttgtatatggtattccggaattccgtcttccaaaacagaaagtcgttgcaaaagagatcgcaaaagtaaaagagcttggtgttcactttgagacaaacgttgtaatcggtaaatctactacaattgatatgctgattgaggacgaaggattcgaagcagtatttatcggatcaggagcaggacttccaaaattcatgggaatcccgggagaaaatgccaacggtgtattttctgcaaatgaatacctgacaagaagtaaccttatgaaagcgtttgatgattcttatgatacaccgatcgcagctggtaagaaagttgcagttgttggtggtggtaacgtagcaatggatgctgcaagaacagcacttcgtcttggagcagaagttcatatcgtatatcgtcgtagcgaagaagagcttccggcccgtgtagaagaagttcatcacgcaaaagaagaaggtgtacagttcgacctactgacaaacccggtagaagtccttgaagaagatggatgggtaaaaggaatcaaatgtgttcgtatggaacttggtgaaccggacgcatcaggaagaagacgtcctgtaccggttgaaggttctgaattcgtgatcgatgttgatacagttatcatgtcactcggaacatcaccgaacccgctgatttcttctacaacagaaggactggaagttaacaagtggaaatgtatcgttgcagacgaagaacacggaaagacttctaaagaaggcgtatacgcaggtggagatgccgtaacaggtgcagctacagtaatccttgctatgggagccggaaaagctggtgcaagaggtatcgacgagtatctttcaaataaataagggttatgaccgcagtttcctttgatagggactgcggtttttgtataggttgtgtagaccactttgaaaaaaataatcgttccaattcaagttgtgcaaaggggagaaaactggcggttataaagggcggagaaatagacgctggtttgtgtgttttggctgattttaaaggaggtttggagattagggtttctggacaagaagagttaaaaatggtacaataaaaaaagtattattttgtgaaagagggttattatgaagtataaatatatcttatttgacttggatgggacgattacggaatcgggaccggggatcatgaattcggtggagtatgcgctgaataaaatgaaccgggaggttggtgagcgggatactttaaagaaatttatcggaccgccgttgacggaatcaatggagaaatattatgggatgtctgaggaagaggcactgcttggagtaaagtattaccgggaatattatgcggtgaaaggcatttttgagaattcggtgtatgaagggcttgcggagacactggaatccttggagaatgaaggatatatacttgcagtggcaacatccaagccggaagagtatgcaaaaaggattgcagacaaatttgactttgcaaaatattttgcagggatttacggggctacgatggatggatcactgatccggaaggcagatgtgatccggtatgcgttggataacctgggcgtagaaagggagaattacgatcaggtcgttatggtcggtgacagaaataatgatatctacggtgcaaaggagaatgggatccaggtgatcggtgtcctgtatggatacggagatcttgcggagcttcaaagtgccggtgcagattacattgcaaagatgccggaagagattgcacaaatcatcggaagatgtaatcatgagagggtttgaatatgagtaacagcgacgcaatgaacagtgagattcggtttctggaagaggttgaagagaaactgaagacacgcattaccgagatcaacgcatcgtttcttgaaggagaaaaacagattgagagcatgcatgattattattgggaaaactatacggaaatggatgagtatggttatgaaaattatgataatcagcaggcacttctcggagaagttaatgcgaacaatgagcgtctgatgaaaaaacagcgccttaagaaaatgatcgactccccatatttcggaagagtggattttctctttgagggggaagaagaaagcgaaagtttttacatcggaatcggcaattttgcgcctaaggcaggaatgacgccactgatctacgactggagggcgccagtgagcggtcttttttatgattatgacagaggacaggcttcttatgaagcaccgggaggaaccattgaaggggagattacttccaaatggcagtataagatcaagaaaggaaagatggtttatgcatttgaaagtgacaccaagattgatgatgagatcctgaaacaggagcttggaagtaacggggatgtacaactgaagaatattgtccgtactatccagaaagaacagaatgagatcattcggaatgtaaaggacaaagttctggtcattcagggagccgcaggaagtgggaaaacctccgttgcactgcaccggattgcatatcttttgtatcacgacaggaaaaatttaaaagcatcggatatcctgatcctttcaccgaacagcgtatttgcggattatatttcccacattctgccagagcttggagaagaaaatatccaggagatgagttttgatctgtttgcgtacagagaattgaaaggaatcgtatcggactgtgaggaccgttatgattatctggagaagctgatccattttccggagatgggaatccgggagagctatttgaagaagcagtctgccggatttgtcggagagatggaaggctttctggcagttctggaagatcagctgatggattttaagccggttaagatccgtactctggaaaaaaccgaagaggagctgatccatctgttctatttcaaatttcaggatattccgatccttgcaagaatggatgcggtgatggaatatctggtggatgaatacgagacattgtataaccggaatcttccggaagatgaggtagaagagatccgggagaaattcaaccggatgtatgtcacccgtgatatttataaaatatataactggtttttggaagacaatgggtatgagacactggcaaaaattccgtatgagaacagaaagctccagtatgaagacgtatttccggtactttatctcaaataccggatgcttggaggaaccagacataagcatatcaagcatctggtgatcgacgagatgcaggattattcatatttgcagtacgtggtactgtcccggctgttttcctgccggatgacgatccttggcgaccgggcgcagacactggacagtcagatgcaggatgtactgacattcctgccgaagattttcggacgtacgatccgcaagatcatcatgaataaaagttaccggaataccattgaaatcgcagagtatgcagcgaaatttaccggggaaaaggatctggaatatctggagcgtcatggcaaaccggtgaccgaaaagacatttgattcggatgaggaactgttaaatgaacttatccgggaggcagatgccggaatggataaatatgagaccgccgcagttctgacggagacgatggacgaggcgtatacaatgaccaggatgctttcaaaccgtggacttccggtaaactgtattgaccgggacagcagtacctttgaaaaaggcgtgacagtaacgactttctatatggcaaagggactggaatttgatcaggtattcggcgtgttcccgaagaaagaaaatccgatgaccgggcaggcaaaatacatctgtgcaacaagagcactgcatgagctttatatgtatgaaagggcataactgtacagactgatacagcgaaagagaggaaggaacaggatgaagataaccgtactgacggttggaaaaataaaagaaaagtatctgcgggatgcgatcgcggaatatacgaagagactgagccgctactgcaagctggagatcattgaggtggcggatgaaaagacaccggacaatgccagcgaaaatgcagaggaaatgattcggcaaaaagaggccgaacgtcttttgaaatatatccgtgaggatgcatatcttattacactggagataggcggaaagcagctgacttccgaagagttttcagagaaaattgaaaaacttggcattcagggaaccagtcacattatttttgtgattggcggatccatagggatcgggaaggcagttctggaaaaatcggattatgcacttagtttttcaaaaatgacatttccgcaccagctgatgcgtgtaatcctgctagagcaaatttaccgtggataccggatcatgtcgggagaaccctatcacaaatagaaaagaggtcattaacagttaaagataaattataaaatcatataagtagatattgagttttataagatattagactagaatattatagagatgagcaaaacacattaattcaaaagtaggacgtggcagttagtttccataaagtttgaagttacgattttgttcttgaaaaatctctttaaagaattttcagggtttgttgtctattgttcagttatcaatgttctttttgttgttgtcgtttcatgcgacagcttttatattatatcaaagtgtttcatgtttgtcaacaacttttttaaattattttttgttgcttttttgaatctctcaaacagcaactctgatatattatcatatatcttcttgcttgtcaataacttttttgaagtttttttcaaaagttattttcaaacaaaacggagaaagagggattcgaaccctcgcgccggttgcccgacctacacccttagcaggggcgcctcttcggcctcttgagtatttctcctcagcccgatccaaggtctgtatttaactgtgtgtttacatacttttaatgtaactccacagcgcattgataattatacctaagaaccctttttctgtcaacggttttttcgattatttttttctttttttaagtttgttttctaattatctatatatagaagaaacagactctttttcactatatctagcaaagagtctgtcctttttaccttatctttattttatgcttcctttggttcatattcagatatggtttcttctattcttctttttacttcttttgcgatctctgtcgtcttcatattttgatattcttcataataaatcggttccaggaaatgtacctgtaccgttaccggtgcgatactatttgtatcaaacggtttaaaagaatcaatcaacgcaatcggtatgatcgggcatttcgcttttgttgccgccttgaagcttccacctttaaactcaagaagcttgttccccatcttcgagcgggttccttctgcaaagatcagatagttccttcctttctttacttcctctgtaacatccatgatcacttgcatagactgacggatatcttcgcggtcgatcatgtaggccttcatacatttaaatgtctgcttgagaagtggaacatttgccacttctttttttgccaccaccgaaaacgggcgcgggcaggcatcaacaattgcgagtacgtcataaagcccttgatgattcggaaaaaacataaaccctccctctttggggatgttttcttttccatatgcttcgattgttacatttccgcctttattggctcttttgacaatatatttcagaagcttatatcgggtgatctccggatacttgtctacgtgcgcggcatagtaacacagcttgcaccacataaacggaacaagcagaatattccgaattaccataagtgcaattcttttcacacaattcattccctattcctccgcatactctttgacggctgtctcgtataaattattgccctcggagtcgatcacaacaattgccggaaggtcttcgatctccaggcggcggattgcttctgtgccaagatcatcatatgcgatcacatctgctcttttgatacactttgaaagaagcgcgcctgctcctccgactgctgcaaaataaactgctttatttctcacgattgcatcctggacagcctgacttcttttcccttttcctatcattccgccaagccccagatccagaaggcgtggtgcatatttgtccatcctgcttgctgttgtcggtcctgctgagccgatcggtcttccttctctcgccggagatggtcccatataataaatcatctgattcttaatatcaagtggaagctcttttccttctgaaagcacttcatccattcttttatgagcagcatcacgggcggtataaataactcccgtaagatatacataatctcctgctcttaaatcctgtatttcttcctttgctactggaactgtaatatgtctttccatatccttttccttcctgattctttttctgtattctgctgcggcgtttttaaccgctaacaggagtcttataattctcttaaaataatttcagccagtttctcaactgtaaagtctacaaaactaatgcactgcgcttttctctccggagaatttttttcttttcctcttgtcagcacacgacagcaggttgctccgcaatgttctttaaatgcgtcgtgaaactctttcgtcagccgctggcatttcaaaaaggcttcatctccaggtgttcttcttccgaaaaaatagccgatgcacatggttgctcctgcaagcgcaccacaaatacagccaccatctccgagcccccacgggaatccggatgacatagcgatcgcatcatctgacatatcaagatcaaagccctttttgatcgcatagatcaccgactctgaacaagcgaaccctttctgaaaaatctcaaccgcatcttttcgcattgcgtctacgtctacatttgtattcataattatcctcttttcatttcctttaaatattacacatcctctcaccgggcagaaaccatttgtaacatgcttcatcttcgcacgagtacatatcttcggcacggaaagtcttttcaggatccccccggtaaattaaatagtgcggatcacatggcggttaacatgacagcaaatatttacagctaccggaagtccggcaatatgagtcggataagtgttgacattgacagccagcgcggttgtacttcccccaagtccgcccggtccgattccaatcttgttgatccgctccagtaattcttcttccagttcttttacatatggaatgtctgaatggcttccgacttctcttgtaagtgcttcttttgccatcagtgcgcatttttcaaatgtgccgccgattcccacgccgacaaccatcggaggacaggcattcggaccggcatcttttactgccgtaagaactgcttcctttactccttcgattccgtctgccggtttcagcataaatacacggctcatattttcgcttccaaagccttttggtgcgaccttgatcttcacctgatcgcccggaacaattttataatgaatgattcccggtgtattatcttttgtattctctctgagaatcggatctttcacgacggattttctcagatatccgtcaacataaccccgacggatcccttcatttaccgcatcttccaggttgccgccttcgaaatgtacatcctgtccgatctcaagaaatacgactgccattccagtatcctggcagattgggatcatatcttttccggcgatcttcagattatcctgaagctggcttaatatctttttccccagtggtgacttctctgttgaaactgcatttttcatcgcaatgtccatatcttttgaaagaaaatggttcgcttcaatgcacatttctttgatattctttgaaatctcttccacgttcaatgtacgcattggtttttcctcctgcatttcataatctgatttttattatactatggttttttttcatctgcaatgtaatcatcttcaaataaaccagtattacctctaattgttaaccttataaaattttaagttgacattctttcttttgcatggtaaagtgtgaaatgtatttgatatttttttaccaaggaaggtttacttatgatttctgaaattgaaacaactacagatccggtgctttcacgagaagatgcgattgcaatcctgaatacaccggacgaagaactcgatcatctcattgcacaagctgaaaaactgcgcagaaaatataagggcaatcatgtaagtattcatattcttaccaatgcccgcagcggtaactgctcacaggactgcgcttactgtgcacaatcctgtcgttcaaaagccgatatcgacaaatataagtgggtagctgatgagaagttatataaagataatgattttgtaaatgaacatcatctttccagacactgcatcggactcagcggtatgaaattcaccgacgaagagatcgaagaactggcttctaagatccgcaagatgaaggaagacggaacccacctttgctgttccatcggatttcttactgaaaaacaggctctaatgttaaaagaagccggactcgaccggatcaaccacaacctgaacagcagccgggcttactacagtcacatctgttctacccatacttttgagcagcgcgttcagaatattaaaatgcttcagagacttggatttgaaatctgcagtggcggaatcattggaatgggcgaaagcaaagaggatgttgttgatatgcttctggagcttcgtgaaatccagccggaagctctgccgatcaacttcctgttgccaattccgggaactccgctcggtgatgccgatatttccgaactcacaactgagtattgcatgaaggttctctgccttgcaagacttctggttccgcagtcagatatccgttgtgctgccggacgtgaggtttattttaaaggtgaagaaaagaagcttctcagcgttgtagattccatcttcgcttccggttatctgaccgcagatggtcagggaatcaaagatacgatccggacgattacggatgctggttttacatatgagatcgaatctgcttaatttattgatacgctgaacaccgtggatgaactaaaatagtgtgaatactatattttatggacgttcgaggtgttcaagaattgtcggaattacatagcaatggaacaatccaattacattattaacattctaaaaggagaatacttaacatggctcagggaaacactcagacacttagaactaccaatacttacgcaatggctgtcaccgctcttatgaccgctgtcacctgcattcttgcaccgctttccataccaatcggaccggtgccgatttcacttactaactttgcaatttatctttctctctatcttctggattggaagaaaggaacgatcagctatatcctttatcttcttctcggacttgtgggacttcctgtattttccggattcaccggaggaatcggaaagcttgccggaccaactggcggatatatcattggtttcatcccaatggcaatcattgccggtattgtaattgacaaattcagtcagagatggctccagattcttggaatgatcgttggaactgcaatctgctatgcattcggaactgcatggttctgcattcaggcaggttacactgtatctgctgcccttgcagtatgtgtcattccatttatcccggcggatctgatcaagatggtgattgccatgatcatcggacctgaaatccgcaaaagactcggagctgttgcacagtaagatgcacggcgtctgccagaatatttgaagtctggcaaaataataatttagccccctctacaaagtccggaaagcctgtttgctgcagcgtttccgggcttctttgtttttttaatccggcttttaccagagcaaacgcaagccatgccataacatttctttccatgcagcctcacaaaacaaagcaagagaccagacaaggcatttgcatattccctgtccagtctctttatgatttatcctgcttctgtatttctactttcgctcagatctttattcttctgtctgctcttctacaaccgtctcagcagttgcttctgtatttgcttcttctgcagtctcttctgcgttctcctccagttcacctgaagccctgcgtacctttgcgatacttgcaacttcttcgtgttccttcagattgatcagtttaacaccggatgtgattcttccgagtacggaaatccccgcacattccatacggatcacgataccatctgtgttgatgatcataatctcatcatccggacctactgcctttgcaccgactacatttccggtcttctctgtgatcttatagcatttcacgccttttccaccacggttctgggctgtgaattcttccatgcgggttctcttgcccatacccttttcagatacgatcagaagctcttcaccctgcgcatcaagctgcattgcaacaacttcatcacggtcacttaaattcataccacgaacgcccatagaggttcttccggttgagcgtacatcagattcatggaaacggatgcattgaccatactgcgtaacgagaataacatctctttcatcatccgtaatcttaacttcgatcagttcatcatcctcacggagtgtgatcgcagcaagtcctgtctttcttacatttgcgtaatccaggatcggcgtcttcttaacaagacctttcttggttgccatgaacagatagtcaccttccttgaaatccttgatcggaatcattgctgtgatcttctcatccggctgaagctgaaggatgttgataattgctgtacctcgggaagttcttcctgcttccggaatctcatatcccttcaggcgatagcagcgtccggtattggtaaagaacataatatactggtgagtattggtcatgaacagctcttctacatagtcttcatccagagtctgcatacccttgatacccttgccgccacggttctggctcttgaaagtatcgttgctcattctcttaatatatcccatcttggtcatggtgatcactacatcttctctcgggatcagatcctctgtagaaatgtcgtattcatcaaatccgatggctgttcttctgtcatctccgtatttttcagagatcacaaggatttctttcttaattacgccaagcagaagctttctgtctgcgaggatcgccttgtactctgcgatcttcttctcaagctctgcatactctgtttccagcttctctctttccagaccggtcagagctctcagacgcatatccacgatagcctgggactgtgcatcacttaagttaaagcggttcatcaactctgctttcgcaatctgtacggtcttggatccacggatgatcttaataacctcatcaatgttatccagggcgatcagcagaccttccaagatgtgtgcacgttcttctgccttattcagctcgtatttggtacgtctggtcacaacgtcttcctgatgtttcagataatggttcaggatttccagaaggctcataaccttcggctcattattgaccaatgcaagcatgatcacaccaaatgtatcctgcagctgtgtatgcttgtaaagctggttcagaacgacattcgggttcacatctcttctcaattcgatgcagacacgcataccttcacggcttgactggtcgctcaggtctgtgattccatcaatcttcttatctcttacaagctccgcgatcttctcgatcaggcgggctttgttgaccatatacggaagctcggttactacgattctgtgctttccattctgcattggctcgatattagataccgcacgcacacggatctttccacgtcctgtacggtaagcctcttcgattcctcttgttccaagaatcgttgctcccgtcgggaaatcaggtcctttgatgatctccatgatctcttcgatcgtggtctcatctttatcttcaatctggtcatcaataattttcacaaccgcaccgatgacttctcttaagttgtgcggtggaatattggttgccatacctaccgcaataccggaggttccgtttaccagaaggttcgggaatcttgacggaagtacggtcggttctttttctgtctcgtcaaagttcggtgcaaaatcaacggtatctttattgatatccgctgtcatttccatcgaaatcttactaagtcttgcctcggtatatcgcattgcggcagcaccgtcaccgtccacagaaccgaagttaccgtgaccgtctacaagaatgtaacgggtagaccagtcctgtgccatattaacgagggctccgtaaatagaactgtcaccatgcgggtgatatttacccatggtatcaccgacgatacgcgcgcatttacggtgcggcttgtcaggaccgttgttcaactcgatcatcgaataaagaatacgtctctgaacaggtttcagaccgtctcttacatccggaagcgcacgagaagcaataacactcatggcataatcgatatagaactcttccatggtttttttcatatccacttcatgaactttatcaaaaatattatcttccattggtattctcctatatatctaagttcttaacaaattttgcattctcttcgataaattctcgtcttggttctactttatctcccatcagggttgtaaaggtaagatccagttcggaagatgtctcatcgtccattgtcactcttcttaagattcgatgctgcggatccattgtggtatcccataactgctctgcgtccatctcacccagacctttgtatcgttgaatcttattgttctgatcacgtccaacttcgctgatgatcttcgccagttcttcatcgctgtatgcataccagactttcttgttcttctccagcttgtaaagcggcggctgagccagatatacatagccctgtttgatcagctccggcataaaacgatagaggaatgtcagaagcagcgtactgatatgtgctccatcaacgtcggcatcggtcatgatgatgatcttgtgatatctcagtttggaaatatcgaaatcatcatggattcctgtaccgaatgcagtgatcattgccttgatctcggcattaccgtagatcttatccagtcttgccttctctacattcaggatctttccacgaagcggcaggatcgcctgggttgctctgtcacgggctgtctttgcagaacctcccgcagagtctccctctacgatgtagatctcacacttggatggatccttatctgaacagtccgcaagctttccaggcagtgacatgccttccagtgcggattttcttctggtaagatctctcgcctttctggccgcctctcttgctctctgcgccataaccgacttctcaacaattgattttccaatagcaggattctgttcaaggaagatctgaagctggctgctgacgatactgtcaaccgcacctctcgcttcactgttaccgagcttctgcttggtctgtccttcaaactgaggatcctcaatcttaacactgatgatagctgtaagaccttccctgatatcctcaccggaaagattcggctcactgtcttttaataatttgttctttctcgcatagtcgttaaaggtctttgtgatcgcatttctgaatccgaccacatgggtcccaccttccggtgtcgtgatattatttacaaaaccataggtgttatctgtataagaatcattgtgctgcattgcaacttcaacttctacattatcttttgttccttcacagtagatgatctgctcgtaaagcggagtcttactgcgatttaagtactgaacgaactccttgataccgccttcatagtggaacactctttccttcggttcttcatcccggagatcggtcaggctgatgcgaagtcccttggtaaggaacgccatctcacggaatctctgttttaacgtatcataatcaaatactgtatcttcaaaaatagtttcatccggaaggaaggttacctttgttcctgtcttctccggatcacattcgtctacaaccttcagcttataaacaacatgtcctttttcatatctctgtctgtacaccttcccttcgtggcagatctcaacctcaagccagtcagaaagcgcatttacaacagaagctcctacaccgtgaagtccaccggataccttgtatcctccaccgccgaatttaccgccggcatgaagcacggtgaatacaacctctaccgcagggagtcccgctttgtggttgatccccaccggaataccacgtccgttatctataaccgtaattgaattatccggattgatgaacacctggatatgatcacaatatcctgcaagcgcttcatccaccgagttgtcaacgatctcatagacaagatggtgaagtcctcttgaagatgtactgccaatatacataccaggtctctttcttactgcttccagcccctccagtatctggatttggtctgctccatattctgcactcatattgatcctcctaattctcttttgatacatgtccgttctgaacatggaatactttatttattgaaaatcgatgattgacaaactcgtcaagtcccgtacaggtgatcagagtctgtatatcatgaatactgtccagtaaatagttttgcctgtgtttgtcaagttcagacaatacatcgtcaagcagcagcaccggcgtatcctttatgatctgccgtaccagctcgatctcagacagtttcagcgaaagtgccgctgtcctctgctgcccctgcgatccgaatctgcggatgtcgatcccacctgccataaaacagatatcatcccggtgaggtcccaccgaggtactcttcatcctgatatcgcgctccctgttcttctcaagcgccgcctcaagcgaaagtgctccgcatccaggctcatacgaaaggctgatcctttccctgcctcccgtcagtttatggtgaatgtctccgattatcgcattgacctcctcgataaaccggatccttctctgaataatcttttctccatactgaaccagctgcatatcccatacatccagtgtgtccagtatatcatctctgtaataggcatccttcagcagacggttccgctgattgagtgtgcggttataatttgccaggtcactaagatacaccttatcaagctgtgaaagctccaggtccatgaaccttctcctctccgccggaccatttttaataatgttcagatcctccggcgagaaaaacacaaaattcgtcagaccgaaaagctcactcgccctccggatcgggaccttgttaatcgcaatccctttcggactgttcttcttcaggtgcatatcgatctgccatggaacgccatttttctcaatgacagtctcaatatgagcctcatcctgcccgaatcggatcagatcccggtccttcgtccccctgtgagacttcgtggttcccgacaaatacaccccttccaggatattcgtcttgccctgcgcattatcaccgtaaaaaatattcgtggcatgatcaaattcaatattcaatatttcataatttctgtaatcttttaattttaatgatttgataatcatacctgtgccagcctatttttcaatcttgatctcttctccattaaatgtaacaacgtcgccgtcatataattttttaccacgtctggtatctacttctccattaacctttaccagaccttctgtaatgacttccttggcttccacaccggatcctacaagacctgctgctttcagtgcctgaccaagcttgataaattcatctctgagtttgattgtctccataatttttgtcctctctaaattcctatactgctccactgaagttcaccggaagaatcaggtatacatagctttctccttcatccttgataaagcaaggagcctttgcattcataaagtaaagatctacttcttcgtcatcaatgacacgaagtgcgtcaatgaggaacttcggattgaagccgatcaagaggtcttttccctctttagtgatcataatctcttcatccatcgtacccttctctgacttgatcttaagttccatcatttcatcctgaatgttgatgatgatcggcttcttatcaccttcttttacaagaagagttgcacggtcaatacagttcaggagttctcttttattgattcttacctttgtctcataatcattggacagcatctgctcgatacggaaatattctccttcaatcagtctggataccacaacggtatcatcaaattcaaatacaatgtggttggctgtgaaatacagtctcacttcgctgtctgcttcacctgaaaggatcttgctgacttcgatcagggtctttcccggaaccacgatcttcttcggttcataagattccttcagctcgatcttgcggatggaaatacggtgtccgtcaagggataccactttcagaatatccccgttcatatcgaagagttctcctgtcatcagtttgttgctgtcgttgtctgcaattgagaaaatggtctggcggatcacttctttcagtgtgaactgggaaatggaaaccggattttctctctcaatatacggcagataagaaaaatcttcaccggatttaccggaaatattgaattttgctttttcacaggtaatgagcgtctgaaagttcactccactttcaatcacgatttcattatcaggaagctttcttacgatatctgagaaaatcctcgcatccagtgcgatcattcccttctcatcgatctgccctctgatcacagtctcgatcccaagctccatatcgttcgctgtaagtttgataatatctgtagttgcatctatcagaatgcattccaggatcggcatggttgtctttgtcggaacagcctttgatacaatgctgacccctttcacaagatctgatttaagacatctgattttcataatgtgtaaaactcctttcgacgcgcaaaatatatatttatataaaacaaatccgtagttatcttagtagtgtctgttgaattgtggacaagtactttaaggccttgatccaaaaggatttaaggctttgacaagtccgtggacagttctttttcttccctggcagatcatggaaaacttttctacagcgggctgattttcttctgaatgatctcgatcgtatttctcaaagtctcatctttttccacatcccgggcaatcttgtccacaccgtggttcacagtggaatggtcacgccctccgagcagatcaccgatactttgaagagacgcatccgtcatctgcctgcacaggtacatcacgatctgtctggctccggccgttcttgcatttctccgacttcccttaagttcagagacggaaacattaaaatgatcggagacaacatccagaaccagctccggcgtcaccttgtggctatcgtccggtgcgatcatatccttcattgcctctgccgccagagaaacatcaaaattctttcttccaccgatccggtataatgcgatcagcttgttaagtgagccttccagttcccggatattggtcttgatgttcatcgcaatatactggatcacctcatccggaatctgatatttttccagttggtccagttctattttcttataaagaatcgccatacgtgtctcgtaatccggcaccgaaatatctgcgatcagtccccattcaaatcttgtccgcaaacgcgcctccagtgtcgtcatatcctttggcggtttgtcgctggaaatgacgatctgctttccggcattgtgcagatgattgaacgtatggaaaaattcttcctgtgtactttctttgccgataatgaactgcacgtcatcgatcagaagtacgtcattattgcggtacttatcgcggaatgcattcatcgccagatcgttgccggtctttccgttgcggatcgccgtgatcaggtcattggtaaatgtctcacttgtcacatacaggactttcttcgatggttcccggtccagtatgtagtgtgcgatcgaatgcatcagatgggtcttgccaagtcctaccccaccatataaaaacagaggattgtaaacctcaccgggagattcggcaactgccagtgatgcggcatgtgcaaaattattattccctcctaccacaaaggtatcaaacgtatacttcggattcagattcgctttttcagctatcgggcttacctctttatgcttatgtgtcttctcttttacgggcgcagtcttctccagatatctgcgctgctgctcgcgcggcagatctctgggaataaacttaatctgatactctgtcccggtaacttccgcgatgcatactttaagcggaagaagatatttattctgaatgtgttcgatgctcgccttaaaattaacggtaagatacagagtgttgcctctgatctcatatacctccagcgggcgtatccacgtttcaaaagaaatgttcgatagaaaatattctacttttagcttttgaatgatctcttcccatttttcttttatgacgtccatattcctgccccattcatcttcaaaataagcataatcatactcttatattctaccttaaaacgatttcagaatcaatcaaaaaccataaacttattcataatttccttaaaataagggtcgaaactttattaaaactgcttgacggagacagcttttttgattataatgaagtacgatgtcttaaaaacgtaaataagcttctattcatataagaaggaatcgataggaggtggatatcaatgaagatgacattccagccaaagaaacgttccagagcgaaagttcatggattcagagcaagaatggccacagcaggtggaagaaaagttcttgcagcaagaagagcaaagggaagaaaagtattatcagcataggtcacatatatgtggccttttcttctatgcaaatttatgtaaatcgggagaataaagtatgaaattttccgaatcattgaagaaaaacagggatttccagtctgtatacagaaagggaaaaccttatggtaacaagtaccttgtaatgtatctcctggcgaatgatctcggacgcaaccgcgtcggaatttccgtcagcaaaaaagttgggaacagcatcataagacatcatttaacaaggctgatccgtgagagttacaggttacacgaagaacagttccaatgtggatatgatatcgtgatcatcgcaaggacgaccgccaaagaccggtcataccatgagattgaaagcgctctcatccatctgggcaaacttcatcacatttattcggactgcaattagccagttcagtatatcgagaagacggatatacactacgaggcactgaaattatgaaaaagatattattatatttgattcgtttttacagaaaatatttatcacctatgaaggtatatacccactgtatttacattccaacctgctcagaatatgctttggaggccattgaaaaatacggtgcgtttaaaggaggccttctgaccgtatggagaatcctcagatgcaatccattcgccaaaggtggatatgatccggtgccttaaacctataggccgtccaaataccgggacggaaatgtttatggaggaaaggttatgacaggaattttaatgacacaggtcagcacaccaatcatcggacaggctgcctggctgctcggtaagatcatggatggtatttaccgggtaatggatttaatcggcattcacaacctgggtgtatgtattattcttttgacaattgtcatctacactttactgatgccgctcaccatcaagcaacagaaattttccaagatgtccgctgcaatgaaccctgagctccagaaggttcagcagaagtacaaaggaaaaaatgatcaggcttccatgcagaagatgcaggaagaaacacaattggtttatgaaaaatacggagtatcaccgaccggcggatgcttaagtatgtttatccagttcccaattctctgggcaatgtactatgtaatccgcaacatccctgcttatgttgggcaggttaaagcggtatacacaccgcttcttacctctatcatggcacaggatggatggcagaaggtcatggaaaagatcggcgaagcaaaaccgatccttatgtccgcctccaaatatgattactctgataaaaacgtactgatcgacgtactgtacaaattccagacttcaacctgggaaactctcggcaagaagcttccggatctgcagtctacgatcgacagcaccgtcgatacattaaagtccatgaataacttccttggacttaacattgcggaaactcctatgaacctcattagcaacggtgtaaaagccggcgcatggggaattgtgatcatggcagtgctgattcctgtcctttcaggactttcccagtacctgagcgtgaagctttctcagcagacaactgcagttacgaacaatccgcaggctgaccagatggcttcaaccatgaagacaatgaacgttacccttcctcttgtatctgtatttatgtgtttcacattacctacaggtcttggaatctactgggttgcaagtgccgttgtccgtatggtacagcagttctttatcaacaaacatctgaataagattccgatggatgaactgatcaaagagaatatggaaaaagctgctgaaaaacgcaagaacaaaaacgaagtggatgcaagcaatgtaaacaaaatggctcataagaacgtgaaaaacattcatgagccggtaagaacagctgctcagacaaaagaacttgaagaaaagcttgaagaagccaagaagaaaaatgaaaatgcaaaggcaggaagccttgcagacaaagcaaaccttgtaaagcgctttaacgaaggccagaaatagggggacaagtcaaatgaatgagattacagtatcagcaaaaactttagacgatgccatcacagaagcttctatccagcttggcgtagcaagtgatcagatggaatatgacgtaattgaaaaaggaagtgcaggcttcctcggaatcggaagccgtcaggcagttatccgtgcccgtatcaaaaaaactgtaacagaagaaatcaaagccgaagaaatcaaaccggaagagatcaaaaaagaattcaagaaggatttccgaaaagaccgcaaggaattcgttggacacaaagaacgtaaagagtacaaagaacacaaagaatacaaaaaagattcgaaaaaggacttcaaaaaagagcctaagaaagaatttgtaaaagaaaacaaaacagaaacagcctctgccgtaacagcagcagctccggtttatgaagaaaagaaagaacttcatgtagccgttgtaacagaagcgacacagaaaatctgtgagaaattcttacaggaagttcttcaggcaatgggaatgggcgaagtaactatcgtatcctccattgatgaagaaggtgctcttgcaattgagatgagcggtgacaacatgggtatcctgatcggtaagcgtggacagacattggattctctccagtacctcaccaaccgtgtagccaacaagtcacaggatggttatgtacgtgtcaaactcgacacagaagactaccgcaagagaagaaaacagactcttgaaaatctcgcaaagaatatcgcttacaaagtaaaacgaagcagaaagccgatctcactggagccgatgaatccttatgaaagaagaatcatccattccgctctgcaggctgatgacagagtttctacccacagcgagggcgaagaaccatacagacgtgttgttgtaacaccgaaccgccgttaaacagtaacgcaaattggttgcatacaccgttataactgaatcgttcacagtaaaccgcagtcatttaatggctgcggtttttttactgttcactcccgtgtcaatcactacgctgattggcacggaggatgcacgttttatcttgaatggcatctcgcccatcgccaaaggcgatttaaaatggcgagatgcattgctggtcacaggtactgtgaacagtaacacggtttttttctactcttcacaataggcacttccattttgacagctttcggggtaaaatgataacatcgcatttattacaaaagtatagaaggaagcaataaaatgggatttaaaacagacacaatcgcagcaatctccacagcaatgactaattccggaatcggaatcgtgcgtctcagcggagaagatgcgttttctattattgacaaaatttacaaaggcaaaagcccgaagcttctgtccgaacaaaaaagccataccattcactatggctatatcatggacggagagcagacgattgatgaagtgctggttcttttaatgcgtgggccgcacagctacaccggtgaagatactgtggaaatcgactgtcacggcggtgtatttgtcacaagaaagatacttgaaaccgtgatcaaatacggtgcaagacctgctgaaccgggtgaattttccaaaagggcttttctgaacggccgaatggatctgtcacaggccgaagccgtgatcgatatcatcagctccaagaatgactatgcactacaaagctcggtaaaccagttgaaaggctctgtccacaataagattaaagaaatccgtgaagtaatcctttaccataccgcttttatcgaaagtgcactggatgatccagagcatatcagcgtagacggatatggtgacagtctcctgggcgtcgtaaaggatctgcagcagaaaatccagtgtcttctggatactgccgatgacggacgtatcatcaaagaaggcatcaagacggttatcgtcgggaaaccgaacgccgggaaatcctctctgatgaacgttctggtaggcgaagaaaaggcaatcgtaaccgagattgccggaaccacaagagatgttctggaggaaaatatccagcttcagggcgtttctttaaacatcatggataccgccggaatccgcgatacctctgatatcgtagagaagatcggtgtggataaagcaaaagaaaatgcagaaaaagccgatctgatcatctatgtggtcgatgcatccagacctcttgatgaaaatgatcacgagatcatcgagatgatccgggataagaaagctgtgatactactgaataagagtgacttatccacagttgttgataaaaaggcattagaaacgttgataactaagccaatgatcgatatttccgcaaaagaggagaccgggatccatgaactggaatctactttaaaagagatgttttatcacggtgatatctcatttaacgatgaggtttatatcaccaatatccggcacaaaacagctcttgccgatgcactttccagcctgaaaaaggtagaagagagcatcgaaaaccagatgccggaagactttttcacaattgacttaatggatgcatatgaatctctgggaagcattaccggagagacgataggagaagatttagtaaatgaaatattcagcaaattctgtatgggaaaataaagacgcatacgacatcgttgtagttggtgcgggacatgccggctgcgaagctgcccttgcctgcgcaagactcggtctgaaaacgattgttttcaccgtaagtgtagaaagtatcgccatgatgccatgcaacccgaatatcggcggtacctcaaaggggcacctggtacgtgagctggatgcgctcggcggtgaaatgggaaagaacatcgacaagacatttattcagtcaaagatgctgaataaatctaaagggcctgccgttcattccctgcgcgcccaggcagataagaacaaatacagcaataccatgcgacagacgctggaaaaccaggataacctggagatccggcaaggtgaagtcgtcaatatccttgtggaagatggttctgtaacgggcgttcagacctattctggcgctatataccgctgcaaggccgttgtactgtgtaccggaacctacctgaaggcaagatgcatttacggtgatgtcagcacgcataccggtccaaacgggctgcaggcagcaaattatctgaccgactgtctgaaggagcttggtattaagatgtaccgcttcaaaaccggtacaccggcacgtatcgacaagcgcagcattgatttcagcaaaatggaagagcaattcggcgacgagagggtcgtacctttttcgttcacaacggatccagaagatgtgcagattgagcaggcttcctgctggcttacctataccaatcctacaacccatgagatcatccgcaaaaacctggatcgttccccactttattccggtatgatcgaaggcaccggaccacgctattgtccgtctatcgaggacaaaattgtaaaatttgccgataaagaacggcatcaggtgttcattgaaccagaaggtctggaaaccaatgaaatgtacatcggcggaatgtcaagttcacttccagaggatgttcaatatgaaatgtacagaagcgtgcctggtcttgaacacgcaaaaatagttaaaaatgcttacgcaattgaatatgactgtatcgatgcaagacagcttcatccgacacttgagttcaaatctattcatggtttgttcagcggtggtcagttcaacggaagttcgggatatgaagaagcagccgctcagggacttattgccggaatcaatgccgcactggaggttcttggaagagaacagttaattttagaccgttcccaggcttatatcggtgttctgatcgatgatctggttacaaaagaaagccacgaaccatatcgtatgatgacttcacgtgccgaataccggttactcctgcgccaggacaacgccgatcagagactaaccgaaatagggcacaaaatagggcttatttcagacgagagataccagatgttgttaggcaaagaagaaatcatccgcaaggagatccacagacttgagcataccaacgttggaacttcccaggaaatcacggattttctcacaaattgcggcagtacgcctcttacttcaggatctacacttgctgagcttattaagcgtcctgagctgaattatgaacttctcgaacctatcgaccatacgcgaacagaaagcttcagccgagagattatggaacaaattgatatcaacatcaaatatgaaggctatatcaagcgccagttaaaacaggtagaacagtttaaaaagcttgaaaccaggaaaataccggcagatatcgattacgatgctgttccgagcctgcgaatcgaagctgtgcagaaattaaagcagttccgaccgctttccatcggtcaggcatcccgtatttccggtgtctcacctgccgatatttctgtattactggtatatctaggacattagaccgccaaataaccaaacctgtattttgatctttttttggatattacagaatccattatttctggtttctgtttttccctttatatagatgtgtacttttgagggcatcacccaaaaagtacacatctattttcaaagaaatggttttatcgtgtactttatagggcaaaaagtatgttttttcatcttttcgtataccttttaggtgcatgattgtatttttttaaaacattatcactttatcgtgtacctttaaggtgctatcttctcagaaattgtgtacctatttggtgcaaaacagtgtaaattactgtttattttccgtaaagatgtgtacttttagggggaaaaaggagcaatatgagtaaaaaatttgagcaacagcttgcagaattaggtatcacattaacacagacccagtttaatcagtttgataaatattacgaaatgctggtggaatggaacaaggttatgaatctcaccggtatcaccgagtacgaagaagtaaacgaaaaacattttgtcgacagccttgcattagtaaaggctctggatatcagtaaagttcaaaccgtgatcgatataggaacaggcgccggattccctggaattcctttaaaaatcgcctttccgcacctgaaaatcacgttgcttgactctttaaataagagaatccgtttccttgacagtgtgattgaagagttaaatcttacggatatccatacaatccacggcagagcagaagattttgcccgtcaggcagactacagggaacagtttgacctctgtgtttcacgtgcagtggccaatttatctacattatccgaatactgcctcccttatgtaaaagttggtggattctttgtttcttacaaatccggtgatattgtcgatgaactttccgctgcaaaaaccgcagtacatgtccttggaggtacacaaaataaaccagttgtattccagcttccaggcagtgatatcagccgttcatttgtaaagatcaaaaaaatcaagcctaccgggaagaagttccctcgaaaagcaggacttccttccaaagaacctattcacggataaacagctatacatgcctgtagtctgtatatgccgcaattgaaattgaactatttttttctttacattgaacttctgctattagttctttttataatagttcaattttaattgttatagtttattctattttgtatttttgatagttcaatttttgtatgctttgaaaatatatttttatttttttgtatgcagttctgccagaaatttattttcctatttcatttcaaaaagcgggtaagttcaattttttacccgcttaaaatctgattttttattttcatttagcttgattatttctgcaaaaagcccaataatcatccttctgttttgtttttcaggaaaagacaatttccatagaaattcccagagttgcatgtcggttttcatggtgttcatgagtagaataagtaccagttaagtaccagttctgtttgctattagataatcgcaaaagttgatcaagagccatatatagccaaatgcgggatgtacaccgaagtgtacatcccgcatttggctataatgtgtacctgaacgtactttatattattcagcagagaaaaggatatccagctgttctgcgaatccttccggttgttcaatttgtggaagatgtctcgtatcctttatgcacatacattctatagcaggtacatgcttctgatattgtttagcaatctcaatactgttttcatcatattgtccagagataatgcagatactatttgtcgccttgcgaatacaatgataaatatttgtctttgtatatccacctttgatgcttgcaaacaaatattttgaatgtgcgttttcattatgagcagattcatggtatatcttcgtcatctgataatctatcgtatcttcgtcatacagatacttatccacaaatttttcatcaattgcttctcttgaatgaataatgttgtacagcagcgtaccaataatcggtatttcgataaggaacttcagcgtcttagttctcttattcggacattttgcaagttccgtaagtgacagtggattcaccatacaaatctttccaatcacgttttcatcatttccgcatgccataactgcaatagcagccgattctcccgtagccacaacatctgcctttccgccaatgatatgtttaataaaatccgtcagcatttgcacataaaggaaattagtataagtaatatttggtttttcagatcgtccacagcctagcagatccacggtataaacagtatgcttttctgcaagaattgccgctacttttttccattctacgccagagctttctgcgtccaaatcatgaagtagcagtagtggtttaccatttccctgttttctataatagattttcccaaatctccagtcataataatttccctcagatgagtttaacaagctgtcttttgttgccatttctataagtgttttatttatcagatggattgtaatcgcaccaagtgttgctaaaatcgcacaacttttcaatttatttttcatcgctaattgtcctttctccgaatcatttttgccccgattcagcaagatcatactcgcaaatagtatctgttttgtgtaatgtttcaccttgcgtcttatagataagtataccataatctccttacagtttaaagattttcatcatgttattgttccttggttttcgacaaaatgtttcacgtgaaacattttgttttctctttttccagctgctcatagccaaatatattttaatatatccaaaatatgatgataccatgggcaaaaggtcagaaagccgatgtaagcttgcttgtaagaggattcttgacccgccaaaaaaatgagtaagtagccatttttttaagaaaaaactgagcggattacgaatgtttttatacattttcacatttcactttgtgtagaatgtttcgcacaaaaaatccccttatttataaaaaatgccaaaataaatgtttcacgtgaaacatttagtagatttagataaagtttagtgttacaattatacctagatgtaaataaaacttcatatatatttgcacactattagaaaggaggtaattgcaatgggacgaataattgccgttgccaaccaaaagggtggcgttggaaaaactacaacagcgatcaatttatcctcgtgtttatcggcaaaagggcagaaagttctcgcaatcgacatggatccacaggggaatatgtccagcggtcttggtatagataaggataatgttgcctatactgtatatgatcttttaatcggcgaagccactatggatcaggtgctatgcaaagaagcaattgaaaatctcgacgtaattcccgcaaacattgatctgtctggtgccgaaatagagttgctcgatactgagaacaaagaatacatattaagagatgaggtgcttaagataagaagtaattacgattacgtcattatcgactgcccaccttcacttagtatgttgacaatcaattcaatgactacagccgataccgtattggttccaattcagtgtgaatactatgcacttgaaggattgagccagctgattaaaacaatcgagcttgtaaaagaaagattgaacgaaaaccttgaaatggaaggcgttgtatttaccatgtatgatgccagaaccaatctttctcttcaagttgttgaaaatgtaaaagataatcttgatcagacaatttacaaaactatcattccacgtaatatacgacttgcagaagccccaagtcatggcttaccaatcaacttatatgatcctcgttcaacaggagctgaaagttatatgttattagcagatgaagtaattcataaaggagaagagtaagcatgacagcaaaacgaggcggacttggaaaaggtctggatagtttaatcaaagaaaataaaactgcgaaacatactgcaccggttaaaaaagaagtagtgaatgccgggccaattatgatgaaaatcaatgatgtagagccaaaccgtgaccaaccaagaaaacattttgaggaagatgctctcttggaacttgctgattcaatcaaacagtttggaatcctgcagcctctgattgttcagaaacggaacgattactacgagatcatcgccggcgagcgtcgctggcgtgcagcaaagcaggccggtgtcaaagaggtccctgttatcattaaagaatacacagatcaggaaatcgttgaaatttctcttattgaaaatattcagcgcgaaaatctgaatccaatcgaagaagcgcaggcatacaaacgcttgctaaatgaattccgtctgaagcaggatgaggtagctgagcgcgtttcaaagagcagaactgctgttacaaactctatgcgtcttctaaagctggacgagagagtacagcagatgatcatcgatgacatgatttcaaccggacatgcacgtgctcttcttgcaatcgaggataaagagcagcaatatattcttgccaataaagtatttgatgaaaagctcagtgtccgggataccgaaaaacttgtcaaagaactaaagaagccaaaaaaagaaaaagaaaagcctgttatccagaatgcatttgtatatgaagatctggaggaacgtataaagtcaatcatcggttccaaagtccatgtcaatcataaagccaacggaaaaggcaaaattgaaattgaatattattcggacaacgatctggaacgtatatttgaattgttgatgtcaatacaggaaggaaaataatatatggaaagtaaaattctgaaatcaattggaattgatccggcgtatatatttctttttcttatcatgctgatcatattgatgtttcttctttatattaatgttaatatgaaatacaaccgtctgaaatcaagctataacgtattcatgcgcggacaggacggtaaaacgctcgaagaaagcttcagcgcaagattcgatgaactcgacgagctttccaacattgcccacgaaaacaaagcggacatccgcatattgtatcgcgcgttgcgaagcagctaccagaaagtaggtattgtcaaatacgatgctttcggtgaaatgggtggaaaactcagcttcgccctcacaatgcttgacaacgataacaatggatggatcctcaattccatgcacagcagagatggctgttacacttatataaaagaaattgtgcgtggtgaaagttacattgagctctctgaagaagaggccgaatcactagatcaggccgtttaccaggaaatgtatgatccggatgtacaggatgcaatcaaaccacagtaataaaaataaagaaataagacaggagaacagttatgttagatattaaatttttaagacagaacccggatgttgtaaaagaaaacatcaagaaaaaattccaggatgaaaagcttccacttgtagatgaagtaatcgaacttgacaagagaaaccgtgaaatcaaaggcgaagtagaagcactccgtgctgagaaaaataaagtttccaaagaaatcggtgcatgcatggctcatggcgaaaaagagaaagcagaagagcttaagaaaaaagttcaggaaaacgctgcccgtatggaagaactttctgctgaagaaaaagaagttgaagcaaaaatcaaaaaagatatgatggttatcccaaatatcatcgatccatctgtaccgatcggtaaagacgacagccagaatgtcgaaattgaaaaatttggcgaaccggttgttccggactttgaaatcccataccatacagaaattatggaaaaattcaacggaatcgatcttgaaagtgcaggaaaggttgccggaaatggtttctattatctgatgggagatattgcacgtcttcactcagcagttatctcttatgcacgtgactttatgatcgatcgtggattcacatactgtatcccacctttcatgatcagaagcaatgttgttacaggcgttatgagctttgccgaaatggattctatgatgtacaaaattgaaggcgaagacttatatctgatcggaacaagcgagcattctatgatcggtaaattcatcgataccatgcttgatgaagctgaacttccaaagacactgacttcttattctccatgcttccgtaaagaaaaaggagctcatggaatcgaagaacgtggtgtatacagaatccatcagtttgaaaaacaggaaatgatcgttgtatgcaaaccagaagaaagcaaagaatggtatgataaattatggaaaaacactgttgatctgttccgttctcttgatatcccggttcgtacactggaatgctgttcaggtgaccttgccgaccttaaagtaaaatcttgtgacgtagaggcatggtctccaagacagaagaaatactttgaagtaggaagctgttctaaccttggcgatgcacaggcaagacgtcttggcatccgtgtaaaaggaagtgacggaaacaaatatttcgcgcacacactgaacaacacagtagtagctcctccgagaatgctgatcgcatttctcgagaacaatcttcaggcagacggttctgtccgcattcctgaagtacttcgtccatacatgggcggtaagtctgaaatcagatagaaaacgaggtaaattttgcataaatatttaaacgctatcggattccacgatatcgcatctgaacgcgaatggtatcagattcttcttgaatccgaaaagaaattttccggatatgaccgtattgccctggacgagcacacagatctctgtgagcttcgcagggaatacggcaacgggattggcatttcttcctgcggctttatcgatgaaaatgatgaagagttccgcagagaatgctatttcccatatttttcaggcagtggagtcagctcttatgctgatattgcagtagaacagaaagcatcctcaccgacctatattggtgtctgcgaagatgtaaagctcggctgcagtatcattttccatatccagaacggaatggaatacataaaagaagccactcgcggtggtctgaacaaaagttcaatctctataaccttttctggtcttgccttaagtgggaaaattttgcttccggtcacaaaggatgcaggtgctgcggacaagagagcgaaagatctccgcaaccggatgatgcttatgagcgcagcaaaggaagggaatcccgatgccattgaaagccttacgcttgacgacatcgacacctatgccgcagtatcaaaaagaattcgcggggaagatatttacagtattgtcgatacgcattttatgccagctggtcttgaatgtgaccaatatgcgatccttggtgagattctgaatatcgataccatcgaaaatcttcttaccgggaaaaaactttatgttcttacagttgaaaccaatgagcttcaatttgatgtatgcgtaccggttgaaaaggtgattggcgaaccggcagttggaagacggctgaaggcacagatttggctgcaggggcatattaatttttaggaaagatttttgacttatataaaaagcatgaccaaatttctcttaattgaaaattagtcgtgctttttgtatatgcgtttcagaacattcggctttacatgaaaaagtcctgtaaaagctatttcacatatcagatcccgctctgttacctcaccatgatcatcctcttagaaaagcatttgacattttcatgttcaaacggtatgatatatgtatatgttctattagtcaaatgaatataagaatcgtctcctaagagaaagccgaggcattccccaaagggaaaaaataaaaaacaactttcagttcgaatctattctgaaaaatgctaatggtgacaacaaagcattccccaaattggggaacgttctaatgttaccaaatcaaaaaaatctgtagattgacaactcgaaaaagagttgataatcttatatatggccgaagggaaaaatcccagaaacccagtaaaatcaagggtttgcggcatgtgtcgtcatagctcagctggatagagcactcgcctcctaagggtcaggtggagcaatcccctttcggaagcgatttatgaaataaatttgaaaattgctcaattacaattaaatacgtctcagtacctcagtaggatagagggttcgcctcctaagcgaaacgtcgcaggttcgattcctgtctgggacgccagcaaacaacgctgaaagccttgatttatcgaggttttcagcttcttttgtttttggcttataacctgtcggataagaacatattcaatttatattttgcaatttcttttgattttcagaatttgtaattcgatatttttatgactgtttgagtagaagagtttgctaacactttttttattttgaaaaaatatcagcagatttttgaagatttgctaacacttttgaaaaattactttgaagctgattgattcaaaagcattgctttcatctccggcgtaagtgattttaaaagctgtaaaagctccatatcactgtctgataagccgttgttttctggctgaacttcctcattttgtggttgcatttctgaatcatggtttagagtggaataaaattgttcgtccatcttttgagcattgtaacgtctatcttcgtctatgatttctgaataaacgtctgtaaccatttctgcttctgcatgacctgtatcgccttgtaccgattttacatcgccgttggtcattttcaatttgtatcctgtggataaatgacgcagactgtggaaaacaacttgttcatagccattttgttcgcataacttttgaaatctgtctctcacaattctactctcaacgggatttccattttccaaagctataacaaggttgtaattgttataagcgtctcctagaaattcctgtaattccttttggtctttttgatattgcaccagtaattctgcaaccgtctttggcaaccatacggtacgattacttgtttctgtctttggtgtttttaatacaagccttgttgtgcaatgcggtttctgtgtcggaaaaatcttgataatatctttttcctttaatttctgcatagcttgtgcatttactctggaaagctctttattgatgattacccttgcgttattcgttgcaatggattgttcatcaataactacatcttcccatgtaagacctgtaatttctccaatacgcattgagcaggaaaacgccaaatgcatacagatggttaataaatcgtcgtctgactgctgaattgcttcacggaatgtatctacactccatacttttctttttaccttaggaactttaggaagcgttgctaatgaagcagggttacgcttgttggtatcaatatattcccaacggattgcttgatttaatgcacagcgtataatgtcgtgtattttcttgatattggcaggttgtacgcaacgtccagtagcttttctgttagctctgggtacttctggaacactcaataaatcgttgtagtaggcagataatttctttgtggtaatctcatttaacttccaatccccgataagtggattgatgtaattttcgatagtaccgactttgctactaaatgtactaggcgaccattttgacgtaccatagagattgacaaatatttttaagaagtcacgaagcgtaatatcttcatcggtactatcaagttcttttttcgattcatcaatctggcgtgcaaactgttcctctaaaggaacaatcacataaccatatttttcttgataatactcaacaaatgcttttctctgctttgcctctttctttgtctctaacgtatcccatttctgtttacgttctcctgcattgtccaaataccagtaaataacggaaaatgttgattttctttttttgattgaagccataatatattctctccttaacagttaattttgatttaaccatttatcgaaagaatctttagatacccgtatggctctaccagcacgaacataagcgaactgtccacttttaaccaatgcgtaagccacttttttactcacacataattgttctgcaatttcctctactgtatatgtctttttctcctttttgggagtttctatatttgatgtatcacttatcacgagtaataataactcctttccgtgtgataacagcaaaatacatacgtttaacaaggtcattatagcatatcaataactcttgcggatatgttttttgccgttgctaacacttttgctaatactttttatatgcagacaaatggctttggcaagctccactggtatctcaaccattcccattcctgtgggctgaaccgtgtcatacgggtgtatcattatcctgtgttgcaggtcatggcagaacgacttttccaacggtcgctcccagatcattgcatgaatcgctatctcccgattggaaaagtcacggcgtacaatctctgatggctcactgcaagcacaaacgtatctgtctgcattattcagttgtcaaagaactattaggctcttgtcagcctgtaccaatctgttttgataaatagactgatacagaatggcaaactaagaagtaagcggaacaggaaagagggaagtgtttatatgaagcgttccgcagatattacttattcgatttttatgtcaaattctaatatcattttcataatggcttctctgatacgaccttttaactccatatccacagcgatatatacatttccatattcatcatataatgggcgaatacagctttttgatatatacgggtcatagaaatctaagattttatcaatggaaattttgtcgccgtccatagccgatgaaatcacataaaatgatggcttcttatacgaacgtttttgtttcaaatactaattttcctcctctaatgactttttcatttgttttaatgcatagtgtcggttttgaaatacaccacttcgggatatattctgcaattttgcaatttccgtatcactcatatccaagaaatagtacataagtacattttcacggtaacggtcagataattgtttaatgacttttgccagctcatcgtcatatacataaatgtcatgtccacatatattgaaagtagtgtaatccgttttatatgtatcccatacagcaactttatctatgataatgtcgggaagctcacaaaaggggatagcttctgcttgattctttttcaactctttgtagtaatcttttacaactccgaaaacagttttttttaaacaactatcaaaacgacacattacagttttctggaagtcagatggtttcacattctcacctcctccctgtgctgttttgtatctatccctctttccactccatataagaaaaaaacagggcagttgctaagtgatttgaaaaaataatcgctattttagataaaatttatatttgctctcactatatagccgacgagaaaggcaaaaattgttcgattcgataaaaaaacgacaaaaaaagacctgcacatttaatgtacaggttaaagaagtgatgatttttcataaaatcagtatttaatttttgttgccatcgtataaacgtattcttctggtgtaggtcgtttctttccaaaataacttgaaaattcagcttgcacatctgggtcatcgctgtaatacatttcatcaatggttgactgaatacgttcttttacttctaatacggaaacaccctgttgatgtgcaatcgctttaaatacttgttttgtatcacgttttttgatacccaacatctaaccacaacctttctgaataaatttatttccattcgataataccatagctcattagtttttcacaaactggaagttacataaatctgcttatcagattatatgctgtgactacatagacaaaaatcgctatgcctgcaaatatcatggcatctttcttcgcacctttatcataacactcctttgcatttgtcaacatagttaatcccataaagacaaacataatcggcagtgttatatcagtagaaactatgtttatcagtcccagtgagccaaaaataatagttaatacgctgaatattgctttccatatacgcatacatagtcctcctttgcaaattcacaacttccgattttctcaattctccaaacttgaatttatacccggtacttgtctcgatttatagtcatatcaaccaaatgaaatacaagtaagataataaaaaaaacggaaactattattattcctgcgcccagcttgataaaatcaattataccgccaagacaaaagagcattgcccatgtcttaatccgttttccagtaactctgcatattttctctgtgtttaatccagtataatctcctgataaaaacagcacacttctttctgtattccttgatttgataaaaaatcttccaacaaaaaagagaacagttgccatcagtaaatcaataaatataattattattttcattttcaacacctctaattctaagttcacaacttcaaattgttttaattcttctcagttccactttcttgcccttcggacaagaagtatccctcgctcaaagagctcggtcaattcaaatcttctgttgctttcagtctctgctgaagactgaaagttaccttcgctttactatttctaatagttttctcacataatcatctgcgtggtttattgaaaactctccatgatacatattaggaagaacttgtataaaactatcctgcaatttttcatgaatgattttagcagattttttcattgattgcttttctttttctccaacataaatttgaacggttgcttcacactctccaatgccatcttttagtgaatatactgagttttcctgtaaaaaggcaatcatatcactctttctaatagcacaagtatctttgtaatattcatttattccttgatatttgtctggaacatgagaatggaattgatatcggaacggagatacgaaagaaaaattatggaaaagaactgcggattacctatatttcaacatatcaggaatatgctatgaaattattccgtattcatccatttgattttcttgtaaagccaatccgagaggaagaacttttccgggtgataggtgaattacgggaactgttaaaagaacggaagaaaatatttgaatatacggatacaaaaggaatccacaagatttcttatgacaagatcctgtatttttatagtctgggaaaaagagtacatatcgtgacatcggaaaaagaatatgaatatcgaggaaaattaaaggatgtagcggatgtaacagaagaatatttcttactgattcacaagtcctatctcatcaatatggaacacgtggagcattacgaatatgacaacgtggttatgaaagacaagacacgtctcagtatcagtaaagcaaatcgcaagaaggtcagggaaagactattacaaacggagaagaaaagattatgaatatccatttgatcacttatctgacaagtaaattattctggatttatactgtgttccgttacaataccatcctgtatccaaaaaatgaggatacacaaaagctatttgcatatttttgtgcatatctgctttcatgctggggaagcatgcagtggggaacgatgtacggagatctgatctttgagctgatagctctgttaattataacagtggcatatcaggcagactggcaacatcatgtctggaatacacttatggtatatattatgggaattttatgtgatgggattccaatcgtgttctttcaacggtatgcggtagcaagaaatccggtgcatcatcacatgggaccgggaactattgtaatgggaaattttatattctttttactggaagtcattattgaaagaaaagtaggtgtaaagagaagttattatataaagaaccgtcattggcttgctatgctttctgtcccggtgatcagcattatagtctgtatcaggatattgctgccagacagaagaggtgtgcggtctacgattgtattattcttactgtttatcaatgtgtttattttctatctgcacgatgaggttcagaaaagttatattgaaacagcaaaacaggaagagatgaaaattcagatgagccagtatgcaaaagaactggagatgatgatgaaatcacaggacaggctgaataagatacatcatgattacaagcaccatcttacaacaataggggcaatggcaaaaacgggaggaaatgaagagattctatcgtatctgaaacaaatggagaatatagccggaacagccttatgtcatcatttatatacagaaaaccgtaatatgaataatctgctgaattatattttggaagattcgaaatcagtaattgaaaatccggagatttctgtagaaataccgaatcatataggggaagaattatttgatataagtataatagtgggaaattttatggataatgctattcgtgggacagcagcttcagatgaaaggagattatcgtttcagatgtattatggaaaaggaatcatgaatatccagattgagaatagcataaaagatacaccaaaagtgcggaatggaatttatctgacaacgaaaagcaggaaagaaggacatggaataggattacaaaatgtgaaactcgtagtagaaaaatatcatggtcagatggagatctgccatacggagaaatcctttcaagtgaaaatattattatatatgaaattagatgaaaaatagtaaggcgatggtgtcttactatttttttcgaccgatttcgtctatttttgccacctcaaggggcatttttaccatttatgaaaattttgtgattttttagattatagtagtgccaaagtcagaaaaaaggagggtagcggttattttgtaaaggaattatagaaaaagattacaagagggagaaagagactatgaagagatttcgaaagtcggctatagccttagtacttgcactcctgatggcactacagggaacagagcctatttttgtacaggcaaaagaggccattgaggatgtacagaagaatgcagatttctccagaccagaggctttgacggaagaggaagcagggattacagattccacatctggagaacaagataagagtcagcagtctgatgcggacgtacaaaatgaaacgacgccatcagaagatacagagacgcaggaagaacagacaactccagcggaagaaacagaagaaaatccgcaggaaaaagaagtggagttgaaagaaccacaggattactatccgattccagaagaaccggaaggtgaactgattgattatgatgccatttccaagacttataagacaggggacaagcagtatacaaccgtttatggaggttatgtcggaacttataagaatgaggatggagacaccgagctggttgataatacacttgtaaaaccagaagaagcagatactccggcatccgaagaagcacaggaagccagcagtgtagtggcaactgaagaaaaggaagagaaaacagaagtttatcagaacaaggcaaacgattatgctatccttcttccggaacagatgtcagaagagaatggtgtaacgattgaaaatggaaagaccagaatcgggatcattccggtagatggagattatacacattccgttattaaagacaatgcgatcctttataatgaagtttacgagggcgcagatgttcagtatacagtactggattccagcattaaggaagatatcgtacttcagcagccaacagacagggaagtctatgaatacgagctgcagattccggggtatcaggcagaagtaaaagacaatcaggtctatatctatccggaagggaagacaatcaaagatgcgaagtatcttctggagacgccatcaatggaagatgctgccggggaaatcagtttcctgatcacattggaacttcgggaagaagatggaaaaacaatcctgaccgtaaaaccagatagggattggctttcggcagaagaacgtcagtatccggtcaggatcgatccgacaccagtagagattcagaagagttcctttaacatgatcggtgtggaagagggaagtcctaccagtcagattggtgacaacaattatccgtatgtcggatttgatgatggtattaagtctgggaaccttgcaggatttggtactgcacaccagaactgccggacttatatcaaagtaaattcaaattttagtcagattccgaaagattccaaaattgacagtgcaacatttgcagtcagtcagaaaactgcatacagtggtggtgcatcccagtttggactttatcgtgtagatcagtcgtggaacacctccatcacatggaaaacaaaaccagtaaatcttacgtttcaggatgtacagaatgcaagtaccagcaggaacagctatatcaattatgacgtcaaagatctggtcaatgactgggtgcagggaactcatgcgaataacggatttgcactggtagccattgccgaggcaaataaccttggagcttctatgcagtgtgaggtactgaataacagggcatccgtttatggaccgaaactcagcatccagtggtcaccggctgaagatccatatctgcgagatatgtcactggatgaaacaacgatcctgcttcgcccgatgacagaaaagaatacaaatggaaagctgaagtttgatgccgtatttgcagacggaattgcaaagagcaaatctacagtagaatattatctgcttccagatgaggaaaatgaagaacatcacgaaacagatgcaaaaccattgtattcctatccagacagtactgaatacaataagcagttcccggaggcgaataagtattacagcaaagattccaactggcagagtgcactgtattcagggctgacgaaggacaagctttataagatcaaagcaaaagcatcgaaagagattgatggaaagctggaaacaggaaaagaagtgaccagtgacagctttgtgatctatgaagtgaagcagtttgatacattcccgaagattgcaaaatattatggtgttccgcttaagaacattatgaaagacaatcaggttatggacgcactggtagtcgcaaataacacgatctttatccgtaacccacagacaaatgttccatatagtcctgcaccgcttaccgatcaggataagatgcggattgacggagcattgatgggaagaggcctgcactgtgaatttggatttgaaccagtcaacttaaatactggtaacttctacatggatcagtccgatgcgacgatgaatgaactgaatggagaattctccattacaagaagctacaattccaaaggaacagaccagcattccatgttcggacgtggatggagctttaactatgaccagtcactttctcaaatggaggacggaagtcttctgtatatgagaggggacggaagttatctgatctttgataagaatgaagatggaagctacactgctccggatggttatgtatatgatttaaaagcagtcagctataaagatacagaccatgactacatcggatgggaactgacagatgcggatcagagcgtctggtcatttgataaatatggaattttacgttatgtaacggatgtgaatggatttaagacagtattagattatgacgatgattataatctgagtaagattacaacaccatccggaaaaacattcggggtaaaacaggataaattcgggcatatcaaggaactgtctcttccagatggtggaaaagtttcttacaaatatgatgagcagggaaatctgatatctgtaacagatccgaatggaacaacaaaagagtacaaatatgatgatgacagccgtatgacaagctggaaagatgagaatggcaatacggttgtaaagaatacttacgataaagaaggaagagttgtagagcagactgatgcagaaaaaggaacggcaactttcaagtacggaaagagttctactacaacaacggataacgaaggaaataagaccgtttatcattatgatgatcagtaccgcacaacatccattgaatatccggatggaacaacctgtgaaaagacttataatgcagagaatcagcttgcttccgaaacgacagcagccggaacaaaaacttacacttatgatacatttggcaatgtagcaacggagacaagagaggatggaaagacagcctcttatacttataatgagcagaataagctgaccagtgcaactggatataacggagcaacggttacttacagttatgacggtaatggaaatatggtcacatctacaaaaccggatggaacagccattacctatacttacgatgacaaacatcgtatggtatcccagacagacggcagaggtgtcacaacaacgtattcgtatgacggaccgaacatgaccggatatgtggatggaaatggagcagcatggggattcacgtatgacgcgatgaatcgtgcagttaccatgacagatccacttggaaatgtaacctcgaacagttacgatgcgaatggcaatctgacttccaagacagcagccgatggcggtgtgaccgcttatacgctggatggtgtgggaaatattacagcaagtactgacgcactggggaataccaccacttatacttatgataagatgtacaacatgaccagtggtacagatccgaaaggaaatcagatcagctacgtttatgataagaattatcagcaggtcaaagcaaccgatgcaaaaggaaatacaattacttataagtatgacagcatgggacgtgtcatagaagagagtaataaagattttggaacaaagctctatgaatatgacaaagcaggaaatctgaaaaaatataccgatggaaatggaaatgcaaccgtatccaagtttgattctcttggacaggtgcttcagtccaaagatgcagttggtaatataaccaaatatgaatatgacgcattaggaaatgaaaccaagattacttatggagatggaagcagccattccaaggaatatgataactgcggaagactcgctaaagagacagatgaattaggtgcagttaccacttatacttatgatgcggcagacaatctggtatcaaaatcagatgacagtggaagaacctggacttatacctacgataatacaggaaaccgcttaagtgaaaccaacccagaaggtggaactaccacatatacttatgataaagcaggaaatctggtatcttctaccgatgaagagggaagaacagatacttatgcttacgacaaggcaggaaatctgactacatccaaagatgcccttggatataccgtatccatgaagtatgacttaaatggaaatctggtatcctctaccgatgaaaatggaaataccagtaccatgacttacgatggtaatggaaacatgacatcggtaagcgatgcaaagggcaacattacagcaatgaaatatgattccaccgacaatctggaacagacggtggatgccctgaaaggaaagaccacttacgaatacgattcacagggcaacagcacaaagatgacagatgccctcggcaatgcgtatagttatgtgtatgataaagagggaaataacacatccataatactgccgacaggggacaaggtgctgatggagtacgatgccatcggacagcttgtaaaatgtacggatgcacagggactcgtaattacctatcaatatgacggagcaggcaacctgatccattcctccgacaatggtggaaacagtatggattatacttatgatggtgccggaaatgtactgacacagaccgatgaacttggcaggacagcaacatacaagtacgatcagtacggcagactcctgaaacttactgaagcagacggaagtatcacatcttatgaatatgatgttatggaccgcattacagcggtaacggatgcggaaggtcataaaacaacctttacctacgataaagtcggcaaccagttatccatgacagaagaagaggaagccacatataaatacgcttacgataagaaagaccgggttatttctcagacaaatccactgggagcatccagcacctttaagtatgacggaaatgataatgtgacggaatctgtcgatgaaaacggtacggttaccaagtatgcttacgataaaaatgacaatctcgtatcccagacagacggaaatggaaatacgacaacctaccagtatgatgaactggaccgcaagatcggtgagacttctccgttaaaagaaacaaatgaataccgttatgatgccattggaaatcttaccaaatcaaaagatccgatgggactcattaccgaatacaaatatgacagcctgagtaacatgacggaacagatttctccaaagggagcagttaccaaatatgattacgacaagcatggcaatgtcatttctgtaacggatgcaaagggaaatgagacacagtacagtgttgacctgaatgacaatgtcacaaagatgacacaggcgaatggtggagagtatacctatagttatgataaagccggacgtctgaagagtatgaccagtccactgggttatactaaaaatttctcttatgataaagtggacaacgtggtaaaagaaagcgacagcttaaagagtaccactacttatacttacgataagctccataacatgaagtcttctaccaatgcactggatggaacaaccagcttttcttatgataagtatggcaatctggtgaaggagacagatccgcttggacggagcaatacctacagttatgacctggcaggtcagatgacttctgcagctgatccgcttggtaagataactgcttacacttacgacccggcaggaaatattactgagatcaccaaaccgggtggaagaaagaccagctatggatatgataagaattataatgttacatctgtaacagatccgatgggctatgttgcaaagacagtctacgataaagacaaccgtgtaacagaagagaccgatgcactggggcagaaggaatcctatacctatgataaggacagcagggtaacttctattacagacaagcgtggattcacaacgggatttgattacgatgcacatgggaatattcaggttgttacagataagaccggattaaagagccatctggaatatgacaagaatgacaacctgaccaaagtaactgatgcccttggcggtgtaacaacttatggttacgacaacatggataacctggtgaccttcaccaatgcagcaaataagacaacgaattatacttatgacttagaaggcaacctgacatccatcaaagatccggcaggaagaacggagaaattcgactatgatgaaaaaggcagactgaccggacatacacaggcaagcggcaagaaaaccacgtatgattacgacaaactgaatgacctgttggagaaatcttatcaggacgcaaaaggcgagacatccgaaaaggacgtgacctacgcatataacagtgccggggaacgggtatccatgaaggatcagacaggcaagagcagctacgaatacgatgcacttggaagaatcaccaaagtgacaagcggttcgaaaaaggatgtcagctacgtttatgatgacgcagataatctgcaggcaatcgtatacccggatgggacaaagatcagctatgaatacgacttaaatgataatctggtaaaactgacagaccgtaatagaaaagtaaccacttacaagcatgatgcactgaaccgtgtgacagaagttactagaagtaatggaacaaagacggaagtatcttacgatgcagaagatcatatcacaaagattgtgaatacctgtggttcctgcggcaaagtaatcagtacttatgagtacaagtacaatgatcagggatatgtagttggagaaacagctacggaactggaagctggaacaagaaagacgccaagctgggaagactggtacaactggggcgatacacagaaagagacagacaaagcagactgtgagcatcaggaaaaagagatccagacgacacgtacctatgaatacgatgacaactgggaactgacacgctgtacagaaaaagcagagggcggtaaaaagacagtccataattatacttatgacaagattggaaaccggacctcttacgagaagatcgaggatggtgtcagcaaagcaaaatataactataagtacaacgattccaaccagctcatcaaacgcaccaatgcaaagatctggggcgatccgggaacaacctacagctatgataaagatggcaatctgatccaggaatgtgataagacaaacagtgcagatccggttacttatgaatacacagcagagaatcgtttggcagtagtaaaacagggtggaacagtcctgatggcagccatgtacgatggagataacaaccgggtattcgaacttgataacacctataaatgggaagactgctatggcgatgaagtcctgatcccggcgaaccagcgtaccgaagatggaaacagcccgaaagagcagcttgcctctctggtaaaaggcggttccaatgccaaaggatacacactgacagagtatatcaacgatatcaatcgcgagaatacagaagtccttgcagagtatggagcagacgagaaagtacgtcaggcttatacttatggagaaagtggaatcggagaacgggtaagcgttgataaatcggaagaaagcagttattatttatatgacggaagaaacagcgtgaccggaatcctgaccgaaacagctaatctgacgaacagttatcagtatgattcatacggtaaccttacatcaggaacagcagacggtgtcaattactacggttacaatggggagtccacaaatgtaaaaacaggacttcagtatctgcgggcaagatactataacgcagagaacggaacctttacaactgaagatagtgaccttggaacgacagaaaatccattgaccagaaaccgctacgattatacgaccaataatccgctgaattacagtgatccgacaggacattcattgtggagcaggattaagagtacagctaaaaaagcagcgaaagcagtcaagagtgtcggcaagaaaatcgttaatactgcgaaaaaggtagtcaaaacagtagtaaatacagctaagaaagcagcaaaaactattgttaacacagtgaagggggtagcaaaaactgccaaaaatgcagctaaacatgcaaaacagacatatcaatctgtgaaaaatcgtgtaaccagtagcagtacatatcaaaagatcacatccagaggaagtcagtttattcgttctgtaagcaatggggtacagaaaattggaaaaacttatacatctttcaaatcctatgtttcagaaagaacggcagaaatccgctcagaagtggtacgacatatgtgtacgacaacaaatcgtattacagataagcttggaaaagtagactggaatgcggtgaaaaaagtagccattggtataactgcggttacagtttctggtcttgtagttgctgcaacaggcggtttggctgcaggagcagttctggcagcattgccagcaatgggtggcttaggaacggcgatggtttcaggagcagttattggagctattggtggagcttcatatagtgcagtgaattcaggtttgtctggaaatagtctgaaacaagtagcaaaagatacgttagtcggtggtattgcaggagcagtgacaggtggcgttatgggtggccttagttatggggctgggaaacttttgaatgtagtaaggagtgcaggaagtacccataatgatgggattgataaatcgtttaaaaaattagttgcagaagtaaccgaaacaaaattgccagaaggcacttgggaaaaaccaccattagagcgaggagatattattgacaaagctatgggaaataacttgggacacaatttcccgaccatagataaagtagaaaatggtgttgtgactagtgttaaaagccgagacttaggtgcaaagacttatcaaaatggtaataaattggaaaaggtaattgtcaaggacattaataaagtttcaggatttataggagaaacatttaatggtaaatttgttaatgcggaagaaatagtgggtagacaattacaagtagttgttccaaatgtaacattaagcgaagctcagataaatgcagttaataatgctacaaaacatggtattgataaaggtgttaaactcattattacagtaggaaaataatagcaaagtaaatagcttaaggggaatattttattccccttaagtaatagagaggagaaaacggatatgatttctgtatattataatcaaaaatatggtttcttaattgtgcctaatgccattgaaaggtttatgggatgttatatttctatcgaacctacaattgaaattatggctgaagaaacaatagataagataggctgtgcaattagaaaaggaataaaaattgcagaaagttccccaaaagtagacgaatctcaattaaacaatttttggaaacaaacaaaatataaaagttttccaacattttccaagaattatcaaagaattgatttgaaacaaaatggagatgaattagaaattagaagatgggaacggaataatagagggggatattcgcgaaaaacggaagaaaaagattatattaattttatagaaatgtcggattatgaattgggcttgtttataaaaaaaatgtttgaaccatgtgaaattagaattgatgaaacagaaagatttgaaacattagaggggaaaataattagttattcgattccaaatgagcattataaaaatattggtgatggtcatacagattcttatatgacatatagaaatgaagattatgataagttgtatatttcttttttgataggtgatggaactgattgtacagatgaagtaagcataaaaaatcattacaaaaaaatatacaagcaaatgtcgaatattaaatttgaaagtaaatgtaataaaaaatatgtacattttttaacagaaaatggagaagtattgctgagttttattgataatggttatgtggagttttttatgtgcattccatataatattgaaagaaaagttcaaaaggagtcaatagaacagtatttaaaaatgttattttcgataaaaattgaagataaataaagcgtgaaggagagaatatgcaaaagaagaattgtgttttgtgcataagtataggaattatagtatgtatattgttatcagcttgctccagacaaccagactttgatgccaaatcctacgtccaaagttctcttgatgcacactatcatggagaatataaggactatgcgaatctgttagaaatctcggaaaaagatgccaagaaagaaatcgaagaggattttaatgagagtatccaacagcaatttgatgattccgataacattacggataaaggaattgctgattatgcggaaaaactgacagaagtaaagaaactggcaaaatacaaagtacaagatgtgaaagaagaggatggagtctatacagtaagtgtacaagttgaaccatccaatgtatttcagacattgcaacaaagctctacagaggtaagcaatgaaaaaataaagcagggattggatggaaatgatccggaagtctttgcagctgtattaacagaaagtgtccagaagagtcttgaaaagaacagatatggaaaagctgttactgtaaacgtatccgtggaaaaagataactcaggaaaatatggtcttttggatacagagatgaataagttggaagcagcgatgttcccaacagaataagaatgaatggaaagctatcagaggaaaaaaactggtagctttcttttaaactccaagacaagaaaacttgttaaaaaagctattgtaatagtagaaaaattataataaataatggatgacaagagtcttttattcattatgagaaaaagaaggaatctcctatgaaccaacaagaaatattcacgtaagatggaaaaaagtgctgtaatcgaagaggttgcagcatttttttcttcgacatttttcgaacattataacgtacctatccggtcaccgccatgctccgatttgatttctatatcaaaaatcagatcggaggaaagataaatggcttataacaagacaagtgaagaacgaaagtggaattattggaaagaacaggaagaaaagaaattgcgtgaactgggaatggaagaagagaagatccaaaagctgcgccagatggacagggaagactttctggaagagcgcagataccgggaacatctggatgaaacgatgcaggatatggattccataaaagaaaaggacagcgagctgtttgcaagggatgtaaaggagcttctggatcacataggtgataagcgaatctatgaactattgaaagaaacggagcatcagacactggaaatcctcttactcagtacatggggatattctggaagagaagttgctaagattatgggaatggcagaacagacgatttataccaaaagaaaccgtttgagaaaaaaattaaaaaatttatcaaaaattgaataattatggcgtttttcgtcggctatttaataggcaggtaaattttgccagtgtactttgacaacctcataccagcattacaggtacgttcccgtaagtagaagcgtggcaggaagacgcgaggacagatgaaaagggcatggaagaaattagaccagaaagtgagaggcagagttcttttgtggcgttttcgtttcgagcgaatcatctttaactgaaacaggaccgtggcggtcttttgcgaggatcacttacgaggggataatgatacataggaactgccagtgagcagaggatggactttgggttgtaatcagcaagacttttagaaaatccgtgagcggtgcaatgccaagcatccgcctgtaatgttcccgtaaggcaatgggggagtcgaggacaaatacaacgccaaaaatcaaaagtataagaaatcaaggaagaatgtgtcgttgatatcagatacatacggctgtagggagaaatcctttacagccgtattgatgtgatatcagcacgcatatcaggtaacaaattatgtattacacaagagaatatctcaatagagcgcatcgagaaattgatactattttccgagtgctgttcccggaacatggaatggcagtaagggaagaacagattatgttatgccacaaaatgctggataacctgctgggaagaaacatagcactgtgtgacgcgggtgtcggtatcggcaagacgtatgcctatctggtggcctgtgttctgatgagaaaatattccctccttgcagaaggatgttccccttatgagcagcgtccggtcgtgatatccacttccagcattgcactccagaaagcaattcttacagaatatatcccttttctctcccggattcttcaggagaacgggacgattcaggcccctattaaagctgtgatacgaaaagggaaagagcattttgtctgcgatgagaggttggagcaccgaatcgttgcaatcgaagaaaaaaacaaaaatgcgttgcagaaagaagctctgctgtcgttgaaagaacattatgatatggacgaagtgtccaacttaagtgggtttgacagaaggatggtgagtgtaccgaagttctgttcgggagactgcccgaaaagaggctcatgcaggtatcagcagtatctggagcgttccagagatcatgaaatgttcattcagatctgtaatcacaattatctgctggctgatggttatcacaggctgcaggattaccgcccgttattaaaagactaccgagcattgattgtcgatgaagcacataagctgccggatgcggcaaagcagatgtttgggaagagcctctgttatgacgatatccgagaaatctgcttttatcttgggaatgagtaccaaggcccggagataagaaaactgtccgggacgatccggatggtgctggacatcataggagaaaaccacagaaccagatatgggataaaagaagaattccacatgacagaagagtgtgcaatgtatttatatgaggggatacagaccatgaataagatcatagaaaaattagaaaagaagattccaaagtggatcagaaacaagctggaagaaaccaaaagtgtgctggaatgctttttccatcaggataagaagtatgtgctgcatctgaagcaggaccatgaccaccggattatattgtgtgcatccagcagacggattccacagtatctggaccagatgttatggagcagaggaatgggagcgattctgacaagcggaactttaaaaaccggacagggattttcccacattcggaaaatgacaggattacagagagtgcggagagtccgggaatatgtggcagactccccgtttgaatatcagaagaactgtctgttatatctgccaaagaatttgaagacatgcagaagagaaagtcaggaagaggcagagatgatagcagaccatatccattcactgatctgttcgacttacgggcatacgctagtgctgtttacatcttatcatttgatgggaaacgtttaccagatgttaagggatgaaattccgttcccgatgatagaggtgtggagacattcaccggaagagatcacaagatttaaacagatggacaatgctgtcctttttgcagccggctcctgttgggaaggagtagacttccctggagatatggtatcttcgctgattatagtaaaactgccctttgctgttcctgatcccatcagtgaagcacagaagaaggaatatgccagcctgaaagattatattcaggcagtgattgttccagacatgcagaaaaaactaagacagggattcggacgtgctctccgcaccgagacagatacttgtgtcgtgtccattttagacgagcgtgcaggagaaggtggcaggtatcatgaggaagtaatgtgtgcgcttccgagctgcaagatggcaaaagatatcaaggatgtccagcactttattcgaaaccggaaaggcgtggaatactacctgtaaccgttcgtggttctgctacagaaaaagcagattttgcacgaaaagtttggtggtatttcaagggcgttttcggtgggattgttggtattgatgaatagctatttcggcatgaagtgggtatactgtgtatagcgttagaggaaaggaggcagcttatgatatacaaggtggaaacgataaaagatggaacagaaaaatattttttcatcagaaatctggaaacaatgagtattgaagaactgccaagtaaatatctaatgcataagattaaatgtaaacgttcaccaaatacagtgaaacgcacagcattttcaatctgctattatatgaaatatatggcagagaaagaaatggaactcacagaagtctatcagttagattatgaaaaacagacagaacactttgtggaatttttatactggcttaaagccggaaaccatacagagcaaacggctggagaaaagaagtgtccgaatgaaggaacctgcaacgcatacttaaaagatgtgttcaggttctatttatttatagaggcagaatatgaacagtacggaagtctcaaaaccttatcgtataaccagattatagcggttaatcaggtgggagtaaaaaaggtactgcggaatcattcttttaaagcctatctgaaggaagaggaacatcgtgggagaacagcaaaagaaaatcagattattacaattttacaggcctgtacgaaccgaagagatcagcttctgttacttatgttagcagaaaccggatacagaattggggaactactgggagtaaaatatgtcaaagatattgattataggaatcacatgataagggtatgcttccgggaagataatgaaaatgaagcgagagccaaaaatgcggaatacagaagtgccaagataagtaatgatacgtttgaatttctcatggattatctggcaaaatatcggaaaatcctgcaacatcaggattacctgtttgtgaatatcatgggtgagaacattggaaagccattaagagtggacagtgtatatgatatgttggaccgaatggaaaagaaaaccggagttaaaatcacaccccacatgttacgtcactattttgcaaatatgcgaaagcaggcaggatgggaactggaaatgatcagtcaggcattggggcataaacatttggatacgactataaagtatctggactggctggatgatgaactgatagaagcaagtaatgagttttatgcacaacacactgctatttatggggcggaacgtctgctggagtagggaggtgtgagaaatacctatatatttattgcaacaggcagaacacataacagaatctgaagtagatattgagaagaaaaagcaggaactatattcagaaattgatgcacttggaataaaaagcgattcaagaattaacaaattgaaaaagttcttggcagatagaaaaatctggcatctggaagaaatggattatcctttgcgaaattcgtatgaacaatatttaagaggacagatacgatcacaaattgtatctttctatttgaaaatatatgatacggtaaaacaacaacatatctatcaacaaatgcagacgctaaatggaaagcggatatatgaatggaaatatcaaaataaaatttattttctgaagtattatccggaaaaggaaatagctgagacctttgaaacttcttataaaacaaacctattggtgtgggattttacacaaaattgttcagaagttttaaagaaacaaattttttttacgttgagtcgtatcattgccaatacttcaatgtctaaggcttatagaaatgtcaggttaaaatccttaaaacttctttatgattcttgtgttcagttaaatattacggatattggattgctggaaatggaacaagtggaaactattttaaagaattttcccgaaacgagtcaacgaagtattttaggtgaatgcagaagagatgcgtttatgcagcaggaacagatccaatgggaagcaaatgtatggtatctggaacgattacatcttggaaaacatcggatagacgaaagtaaatccttaattagcatttcttttatggaagtcaaggaaatacagaatcgagaaattttacaggcatacatgaaatatgaactgggaattactggacaggcagtcagcacgattgtacgaagatttgtatgtattagaaattttattgaactgctggaacaagaaaagatactggcgattcatgcaactgtcgcagaagtaaaaaagtatgcagacggcttgcgagaacggggaatacaggcaaagggatttaatgaaagaattttcggtatcggtcatttttataaattcatggaagttaaacagtatattacaagaatgccattccgaattgaatatttccaacaaaaagaagtaatagtacatcatgatcgtagcgttgaggaaacagtatatatggaaattttgaaaaaattatatctttttccagagcgattacgatgtatgttcctacatctgtggtgtctaggattacgggcgagtgaagtgtgtacattgaaaggaaatgcttattatcagcagggcgaggattattggattcaggtgtatcaggtcaaaatgaagaattataaaaggattccaatcccacaggcactttatcagattatgaaagtatacttgaaaaaacatgaaattcagcctgaagaattcatttttaaaaacagcagaggtggtgcttgtctatatggtacattccgaactcagatgatagaagcgtgccgggaaaataagattgcaaatggagaatatttatttcaatcacacgattatcgacatacagtagcaactatgttttatgacagtcatgtatcactgcaaagtatcagggattatcttggacatacttatgaagagatgacaagacagtatattgattatatgccgcaaaggattgcaaaagcaaatgatgagttctttgaaatgcaaggaagtagtttagcatcatggctaaagaaagaggaaaaagatggaaaatgatattatatacttcagcgatttccccaatttacaagaaacagggacacgtaaggataatggaaaatttgatttaacgttgcttccaacgcaagaattaaaggaagagtttcgaggttatattatgtatcgctgcaaaaacggaacgtttagagcattgattcaggatcgaacagcttataatcatattgcaaagtttttgaacagcagaataaatcggagaatcaaaagccttggagatagaaatccagaaaaatggatatcacttttaaaaggctggatgttagaacagggaataactattgtaaaagaaaagaagagtgtgtatggtacagtaagctatggcgaagcagtgacgatattatatttcagaaacgtactgaaatttttagggccagaagatttacgggatgagatagaaaaagatgtttgggaactaaaaaatctggatattaaaatcagatccaatccaatttataatgtaaaaacactggatttcagaaaaatatatcagccagatatcagggaagaatgtaagaaagctgtttatatgaatctgcagtatgaagcaataggaactgtacagggagaattgacaataatgaggatattctcagaatatctccaaaaagagtattccaaaataaaaagctgcagtgaaatagacagagaagtgttggaagaatttttgatacatctgtcaacaaaagatacttcccatagtgcgaatagttcttatgtaatttcattaagacgacagttagagacaatcggaaaaatttacagctatgaaagattggagcatttatttattaatacggatattccaccggaagtaaatgcagaatttagagtgtattctgatgatgaaatgaaacgactgaatgcggaaattacacagatggatgtacagattgcaagatgtcttctgatacatcagatgcttggaactaggatatcagatacccttacactgagaccagattgtctgacgagagaaaatggccaagatatgattgaaatatatcaagttaaaactaaaagatataaaaaaccgatcagtaaagaacttgcaaaactgttacagagttctattgaatatacacaggaaaagttcggtgatacagaatacatatttgttaatgaaaaagaacctgaccgcccgatgcagtatatggctataaaaacaaaagtcatgtccatgatacaggaaaagcagttgaaagatgatcatggcgaattattcgggtttggaacgcacatgttccggcactactatggcgtcaaacttacagaaatgcatctggatgactggacgatagcgagactattggggcataaaagactgaataatgtacagcattaccggaaaatgagcaatcaaagaatggcagacgaaaccagagaagtaagacagaggatgagtgacatcatatatatgagtctggcaagatggggtgaagaatatgagcaaatacgacaagatgattgaggaaaatcagagaaaaagtaaagagaaaattgaactggcattgcaagcaatacaagatatgctggcaaataaagaacgtatcagcgttccaaagctgatgaagaaaactggattgtcgagaggattcttttataaaaatccaaccgtccgggatacattgaaccaagcagtagagcaacaggccggaatgatagatccaagaagagaaattctgaacatggcgatggaaaaacagattgaactgttgaaccagaaggtggcagctctgagcagagaaaataaggaactgaagagaaagaacgaaaagttacagaaggcattacggaaacaggatttgaattttattaagaacttataacattgaaaataataagatggaagagatgtgtgcagacacatcttttcatcgttgaggataaaatatatagaatgagaatgggattgttttatggtatactaaaagtgaaatgctaactttgatatgaggtataaaacaatatgacagaaatacaaattaaaaatttaattaaagaatatgaaaaagaatatattgagtttatggaaattgagaaattaccacagtataagatagatttttttgaaattaatgttgaggaaagcgatgcagcaggattcgcttcagccgcccaagcttactataatacgaaaacagatgaacatatattaaggatatgcaaaagttcggaaataccaaggtatattgtgtttcatgaatttacgcatattttagatacggaaatgtatgcaaagcaagattcttggaaatatatggctttgtctggttatacagaatatcatgcagcacaagttgaattgatgataatgttaggagcagatagtatacaaactcaagatttttcatttacagttgatgttgaaataggtaatagtacagttaggaattacctaaactcaagacatcaattagtagtgaatatgatgaatagaacagattttccaagagatattgaagcattaaaaacaacggtaggtgtgctatataattattttggagtgcgttctatatgtaaaatgtatgcgaaagattatactgaagaagtggataacacaattattattcagaaactttcaaaagtattatttgaagagataaatagctttatggttggatggtttaatgaagcacaagtagagctgagctttgtgtcatatatgaaaataatgtggcctatgcttcaaagctattttggaaaagaatgaaagatagtaacagtaaacacagttttgtatacagttaaacccagtaaaatcaacgcatgaggggaactggctacattttaattcccaatctggtggtatgtggctccgacaatcatcaatacatttttagaagcttacgatttcagtggtaaaaagattgtgctttttgcaacatccggaggaagtggatttgggaacactgtgaaagaattgcagtcatctgcatcagacgcagttattacagaaggcagactgttaaattgtggaacgaaacaggaaatcactgaatgggtaaactctttataaataacagcgttatggaggtatacagaatatgggaaaaatagtacagacagcagggagaaatacacttggtgaattcgcaccggaatttgcacattttaatgatgatgtacttttcggcgaaaactggaataaccaggacatcgacgtaaaaacaagaagcattattacagtggttgctctgatggcttccggaattacggattcttctttaaaatatcatcttcaaaatgcaaaaaatcatggtgtaacacaaaaagagattgctgcagtgatcacacatgtcgcattttatgcaggttggccaaaagcatgggctgttttcaatcttgcaaaggaagtgtgggaaacaggcgaaggagatttgtcatacgaagaggaagcgatgcgggcgcatgcaaaaaagatggtatttccaattggtgcaccaaacgatggctttgcacagtatttttcgggcagaagttttcttgcaccgatttctacttctcaggttggaattttcaatgtgacattcgaaccaggatgcagaaataactggcatatccatcatgcaaaaagtggaggcggacagattctggtatgcgttgccggaagaggatattatcaggaagaaggtaaagaagctgtagaaatgaagccaggcgactgcatcaatattccgtcagaagtaaaacactggcatggcgcagcaccggatgaatggttttcacatctggcaatagaagttccgggcgaaaatagttccaatgaatggcttgaaccggtaagtgatgaagaatatgggaaattacaataggcaggggaatgaaatgtttgataacagtattgtattgaacattctgtactaaaatgtgcgcgattccactaatatcatgaacttatgggaacgtattgcggatactttgtgaactttatcctgatacaatgattatgctgatgaaagagggcatagataactgaatacaagaaagagacgaaagcctcagtagttaagaaaaactaccggggctttttttcgtgcccgaatttctcagccaataactgcggatatgtcgacatttcaagcaccatataaagcagtgttggtatctttgtatgaatatgctatacaaagtgaaaatgaaaagctttgtggcaaaatcaaagaagtatttgaccttcagtttgatgatttaccaaacagattcagaaggcttggattggatgacagtctggtatgcccttcttatgtcattaatacatcttttttacaagagaaaataaagaggacaagagatgaaaatccggaacttcgttatcatgaagataatgaagagtatttaatcaggaaaacaaagaaacaatatacgctctcgatccggtggaggaatgggagacatgtaaaaattaatttttaaataatgaatgcaaaaaaaacattaacgaaatttgagaattaatattgttaaaaaatactaattgacaatttcaaagtgaatgatatactaaatacataaaaacgtttgcgcaaacgtttatctacagaaagttcaatcaggaggagaaaaaatgcagaaaaataatatgtcttttttaaaaaatcttacaacagtagcagatgcaagaactgccagagcttcaagctgggatcagagtggcagaaataaagattactggcttgtaaatgcaggggatacagcggttatggcggacgttgaaggaccaggttgcatcaatcatatctgggtaacgactttttgcagagaaattctcggaccgtctattcagcatccggttttaagtggctctgttgcaccggtaactgaaatggaaaatgcggaaggcgttaactgggaaatcaatgatccggattattaccgtaaggtcctgattcgtatgacctgggatgattttgatggtcccagtgtgctggcaccgctgggagatttcttctgtattggtcattctatgccgtcaagtttttcgtcaattccttttaatgtatcttcaagaccgtgtgaggaactgacttttggtggaacggcttccatgaactgctattttccgatgccgtttaacaaacgggccaaaatagaagttatcaatgaaaatgaaagaccgcttggattgtttttccatattgattatgaactttatcacgaagagactccggatattgcttattttcaggcagcatggagacgtgatatgccatgcagtggctggggaaatgatctttgcgtaaactctccggaagtaaacagtgttcctaattttgacggtaaagagaatttcctgatgctggatacaaaaggccgtggtcattatgttggttgtaatctttctgtgcttcatttccagggcagctggtggggcgaaggcgatgacatgattttgattgatgatgaagaagaaccaagtattaatggaactggtgcagaggattattttaaccatgcatggggaatgcagagaaatcagtcaccttataatggtacgattatgcatgacggagatacaaaaggttatcaggtatcctatagattccatcttacagatccgatccattttaaaaagcatattcagatcagcatggaacatggtcatgcaaatcatctgtcagatgactggtcatgcacagcgtactggtatcaggcagctcctgttacttcagtaacgattcagccggtagaagagagaattccgcttaagagaacttttgatattccgaaaccggctcatcaggtagaacttacaccggagatgcaggaagcttacagaagcagaaatgaaagaatggaaaaatttaaagttgaaaaggctgaacagatcagactcaatgcagcaagaacagcaccgtcagaaactggaaacaaagaactggcacataaagtaaagaaagaatttgataaagaaaaataaataagcacgtgtgtagcaaaaggaggggctttttatgaatttaaaaaaatttttatcaatgattatggttttgagtatgacagcagcggtatttaccggatgtggaagcagttcagacagtacatcagatgacagtgcagtagctggaaaaaaaggaacagaaaataataccggtgaagaggattcttcagagggcgataaagaaaaacttactttctgggatttccatacaggaactgaggcagatgttattcaggatatggtaaatgcatataatcagtcacaggataaagtcaaggttgaatattcaagtgtcaatcagacagattatacgacaacacttgtgacaaccgcatatgcaaatggcgaatgccctgatatcctctgggtggaaccggcgacttttaaaaaattctcggatgcggaaatgcttgcagatctttcttcttattatacggatgatctgaaaaaagatattcttccgtcgtttcttgaagcggcaagcggagatgacggaaaaatctatacactgccatttgagtgtgaaacccttggactgttttatgatgcagatgcacttgaagaagaaggtattgaaccaccgaaaacatgggaagaactgaaaagtgcagctgaaaaactcacaacaaaagacagatacggaattgttcttccggtagaaaaaacagcatatacgttgtttaactggtggccatttatgtggatggatgatgcagacatttatgatgctgatggaaatgtaacggccggcaaagacagcatggcagatgctcttgatttctggggttcattttatcagaatgaatactgcccgtcatcattacagaacggaccatggagtattgataatgttgcaaatggcgtcgcagctatgcagattggcggaacatatatgataaatgcagcagaagaatacaacaaagatgggcataatattggagttgtaccacttccgtcaccgaagggaaaagatcctgtaactgttgcaggaggtcagatgatggcagtttccagccagagcaaagatgttgatgcagcagctgactttattttctggtgctttggaagtgatgatacaacttatgtcacaaaatggtgtacagaagccaaatttgcatatccggcgcgccagtctgtaattgaagaaaataaagaactttttcaggaaggcatgaaggcaatattcaccgaattttatgatacggcaagacctgaaccacagtattcatctgaagtaactgatattatgggagatacattgcagtctgtgatgtttggcggaagttcaggagcggatgcggcacagttggcacaggaacagattgaggcattaaactaaaatattaaatcaagaggtagaattatgaagcagaaaggaaaaatgtccggtaaaaaattgaaacagatgtttgtaacatatacatttgttcttcctgattttattggtcttctggtttttattatcataccaatcatatattcattttatatgagcctatatgactggaacttcgctaacattaagcaatttatcggaatacagaattatgtcacaatgtttagtgactctgaatggtggcagtctctgggaagaacttttaaattaactttactgtatgttccggcattatttatattatcaatattatttgcagttttgattaactatgtcaaaaacgaaaaagctgccggatttgtaaaaacagcttttctgcttccatattctatcacatctgtaattgcaagctgtctgtggatgtttctttatatggacagaagtggatttatcaatgtatttctgaaggcctttggactgaaaggagaaaagtttctgggatctacttctcaggcaatggtttgcattgcagttgttttgatatggattaatctgggttataatattattctttttctatcagcaataaaagatataccttacagctattatgaagcagcaaaactggatggagcaaattcctggcagactttctggaagataacgtttccgctattaaagccaaccagcgtttttgtactgatcacatcagtgattgcatcgttccagtgtctggatcttatcatggtaatgaccgggggtggaccggcaaaatcgacagaagttgccagtctgtatatatacaaacagtcatttgaaatgatgaaggctggatatggagccggattgtcagttgtaatgtttctaattttgacagtgcttgccgttattatgttaaaaataaatggaaaggaggaatgatgatatgaagaaaaaaacaaataacatacttgcagtaattcttataatattgggaattgtaatgttgtttccgatttacattttatttatggtaagtttcagaaatgaaaaaactgtttttgtaggatcactgatcacagcatctccttcttttgaaagtataaaatcagcgataacaccggattttcttgttgcaatcggtaattcattccttattgcagtagcagttacgattattgctttaattcttcattcaatgtgtggatacgcatttgcaagaatgaattttccggggaaaaagccaatgtttacagtgatcatcagtactttgatgattccggtatcgtctattcttgtacctttgtttatgatatgtaaacaattaggaattacaaacagttatgctggaattctgttaccggcattgtttaatgcttatggtatatttctgttcagacagttttatatgagtttccctgcggatcttgaagaggctgcaaaactcgacggatgttctacatacagaatgttttttacaatcatatttccgctttcacgaccaattattatcccactgagtattgcttttttcctggggaactggaacaattacctgtggccgttgattgtaaataagaaaccggaatatcgaacagttatggtttatcttgctaacatggtaggcggctataatactaagtggaatgtggttattgcaagtgcaatgcttgcatgccttccggtattcttgatatcacttcttctgcaaagtcacctgcagaacagtataaaaatgtctggcatcaaataggagggaaaacttgtgaaaatcagagaaagttatggaagcaggcggtatgaagaagaatacagggcagctctggaaaagtcagtacattatttcagacagaacagctgtattacagaactcagaaaaatgggttatgctcagacgaaactgcaggtagaatatgaagcagaagagtacggaaagagtgaaatctgctgtctagatgcagaaacaaatactttttttaattcagaatctgcagaaaaatttattgcagaaaatgatctttcgaagtgtgaaaatgtaaacatttatggtgatatcaggcaaatctattgctttggatacgatgataaaaaagtggtttacgcattgacagagtctgatggtatgcagaactacatcacgattccctatatttcgggagaaaacggggaattttgtacagatatttcttctcacaggatctggaagcgtgaatttagcgaaaaaacatcaaatttggattgtgcactgagatttcgtatagcaccggatacatggccgaatataaaaatcaaagaggcagacatgtctcccgatgatatttttgcacatgcttatgaagccatatttaacatggaaataaacagtgaaaaacaggttgaaattcaacttccatatcaaaaactttgttggaattctgagaaaaaagtgcttacatgtggaaagtatcagatggaaataaaatgcgataagaaactgtcttttgtcactatatttgatcagtatctgacggaaataatcgcagataacaaagtattggtactgctaaataatctgactaataaagcaaaagaaatcagtgttattgatattagtggaaatcttgggaaaatccgagtaggcgaagacaatgatccacatattcaagtagaaacggataaagatacagagactgagattgttgtatatggactcagaggactggcatacagtaaagatgcgacagaagcattgcgaagaaaaaagaaagaggacaggcttattttcgcaaatgataaattcaaagttttcgataaccatgttgaagacagctgttatggtagaccagatgcttatatcatcagtccggaggaaattgtgtcagcagacaggattcttgaagaatttcagtggagaaaaacgaaatggggcgacatgacaagaaagtcatggagaactgataagtggaccgcagatctgtcactgaaaaaatatccgacactgaaatctgcttcagatattctttcagcaacatggaatctggcgatgacagtcttcgatcgttgtacgaatggtggctatgcactccctgggcaggagcatctgtggcaggcaggactctttcagtgcaaaggtgaagggtttggagtctggctcagagactctgtacatatagcaatgcgtggcggaaacctgatcgatccggaaacagcaggacgctcactcttgtatgctgtaaaaaaaggatttgacaatggaagtgacggaccggcaatgggggctgttggattgtgggattattatctggctacaggtgacagaagtgcacttgaagagggatatgaaacactgttagaaacaatgacagaaattgaaaacagatataatgaggaaaaaggtcttgtacgtgcagaacagtctacttctaatgatgcgttccctgaaccggaaaatgcaggatattcacttggcagtgaatgttattatatgaaagcatatgattctatggccaaaatagaaaagcttttgcatggagaaaatgaaaaatccaaaaaatggagtaagatttccgaacaattatgtgaaaaaatccgtgaagaatactggaatgatgaggcaggatactttacaagtggtccaaaaggcagtgaagcatatgaaaatcagatatgggagacttccggtgaggaagccgctctgtgggataagttccatattgcaacaccggagcagaaaagagaaatcctgaacagtggaatacatactgcaatgactccatatggaatacgtttgtttcctcatcgcaaagagcataatcattttgtaggaccagtctggccggtgtgggaatcaggatttgcttctgctgcggctgaatcgcagaataaagaattattgctgactatgattgcacagcagatgagaacagctgttttgcataaaaatttccatgaagttcttgaagcggatacaggaaaatcctggagatggcccggacaactttggcatgcttgcgggtttgcagctcagattttatatggtgttttcggaattagttatgatgaacagggcatgagatttaatccgtgtgttccagaaatatttaaagagattgaaatacagaatctgaattatcaatcggcaaaattaactgttaaaataagtggaactggaactgtcgaatgtgttatactggatgatgaaaaggttgattttataccatatagtctgacaggaaatcatatagtccatataaaattaacagaaacagagagtgaatgtatatgaaagcaaagattacagatgtggctcaaaaagccaatgtttctatatctacagtgtcgcatgtgttgaatcatacacgttttgtatccgaagagaccagaaaaaaagtcatggatgcagtagaagaattggggtattcaccagatgcgtctggcaggacttttcgtaccggaaaaaaaatgatgatagggcttgttgtaccggatattacaaactctgtttttgctgcacttattgaagatgtagatgatgtgatatcaaagcagggatacaatctggtcatttccaatacaagggactgcctcaagatggaaaaacaggcactgagaaatctggcttcgggggtcgtagatgggattgtaattgcttctacatcagaagattttcagacaataaagaggcagataccggacaaattcccaatgatatttatggatcgggtgctcccggacagaaattatgacagtgttattcttgactgtcaggaggcaactgcaaagatgctggaagaaatgatccaaaatggtttcagaaagattggttttctggttggattgccacagattagtccgacttatgaaagggtaaaagtataccagcagattttgaaacaatatgagataccggagacagaacagtatgttcgatatattgaccgaaaaaaagacacctatgatgtagctggcgaattggtagaggccggatgtacggcaattatagccacaaatacggcaatgactcacagtgtactgaactatgtggaggatagaaatctgaaactcggcgaggaaattgcagtaggtggttttgtggattctgattttgcaaatcgcttcatgcacaggattccagtggtatatgagccaatgaaagaaatgggaaaacttgccggagagatgattgtagaaaaaatcgaagataaaaatagaaaaattcctgttaaaacgctgacatgcgaatatgactctaatgatttttataaaaaataggcagggagaacgaaatggaacaggaaacacagacaccacacaaacgaagagcacgatataagggaaatactccggctggaatgcctgcatggtgaaggtcatatgtatgcaacagatgtggatcaggaggaatctgcatagcctcgtaagcgtctggcagagcagagctttggagaggacattctgacggtcaaacttcagaatttctgtacaatcgatgagattgcaaaagaagccggtggatttgattttattcttgcagatttcgggggatcgttcatgcagatcgacaatctgaagcgtggtttttctttccgtgcagacggaccgcttgattttcgcctgaatcaggaaaagggaatcagcgcggcagagccagatccacaaaaatgtgctggcggttaaggcatgcgtccgtcctatatgctaaaaatgaagattctgtgaagcgaatcaaaagtattgacagtaaaacaaagaattattacaataagcctatcataaagatatgttaaacgaggctgttacagtagataaatgaactgctccccgtcaagtagacaattgaaaaaatataaatttttcggggatgtgaaaaaactcgattgagttttttcgcatctccctttttgtacctgttgtgtataaatgactgaaatcatgcgcaaagaaagcgcacttcccctaccccatagaaattctttttttgaatctatgcggcagttctgtttctcatcttttttttctgatatttatgtagattgtggcctatcgccacaagtaaaacttccagtttgactgaatgaatacctcttcggacaattctcttgtaccaacggtcgtttttcataattccgaaagtgccttctgcttgtatcgaacggttcattcgtaataacgcaccgtggatactttctaggttttcgattacttcctgatgcatggaagttaattcctgattgatccgaacggttcgattcttatctgtcttcttacatttctctgcatatggacatccactacagtcttcgcattcatacaattcttccttacgtccgtattgatttcccctcacattttttctgtataaaaaatggaatgctttatcgttaggacatctcatgacaccttgctcatcaattctgaagttaactgcacgaaatggatcttcatgatatttctgatccttagtttcctttttaaacattggaaatttcatatacttttcaattccgttctgttcacagaaaatataattgttgtatgagccatatccagcatctgccacaggatatttgggatagaatccataagtttgtttgaagtgctccatcaaaggaacgaaacaatccatatccgaacgataatggttcacgtcaacaactgcaatatattcatctgctacaccaatctgtacattatatgctggcagaagctgatcattgcccatgtaatccgttttgatacgcataaaggtagctgagttatctgttttagagtaactgtttcgattaggaccacagatttcaattttttgtatgtattcttgaagtttctgacagaaagtagtcaagtgttcataatgacgctgttctttggattttcgctttccacttccgtaaacaaatgtacttgtatccagttcccataaaagtactagctgctcaacgatttcattcagataatccggtacatactccggatttgttgtgatctgcaccccgctccatgcgatttctgcattaatctcctcaatctccgcagtgattttttcgtaaagcttgtaacggaacttttcggtagccttcttccatacccaggtatatgtatcatggagagttttcaataaaccacgcagatgattatgtgagaaaactattagaaatagtaaagcgaaggtaattttgaatttaacgcttgaaaaaaggagaaataaacatggcaaagaaagaagaaagatttgaagttacatttagaggcggaagtcagcttaaggatgaaggagttcgccaaatccttgtagatatggagactggggttaactatctttgttggaaatctggatatggagcggctattacacctcttctggattcagaaggaaaaatcatagttacaaagtaaaatcggaagttgcaaaagagaataatgagaattacttaactgatgaggaacagcacaaaatcataattaaggattatgatatgttgtttgaatacagagaatagcaaaaaacggaggaaaaatcatgaaaaaacgcactcttactgtactagttgttgtgttagtatgcacattcttgacggcgtgtagtaaagaaatagacactgtgacggaatctgtaaacgaaaaggaaagtaatgtaataaagaaccctacagttttagaagatacaatagaaattgtttttccagaacagtttgaaggattgtctgggtatgatgaagaagcactagttgactatcttaaagaaaacagtgacggaaattatcagaaaatcgaatgtattgacggacaagttaatatggttgctactcaggaagaaattgagtattggaaaggatatgttgaaaaacatatagatgatcaaaaggcagtattaacaggtatcaatcagaagtatgatatgtgttgtaatgattcatataacactattaatatgtactatgatcaagagctttcatttaaaaaagctttttcatgcgttggaaaaacagctatatattgtgccatgtatcagatattagatggcaatcctgattattcaatttatctaaatatttataatgtcgatacagggaaattagtagttggcggaaatctaatgaatgaagaagtttcatatacagatgaggactgggaaaaaactttctagagaaaagaaaaattttatgctttgcaataagatggatttctattagaatgacaatctggtatgatatattactctgacaggctataacttccagtttacagaatcaagaaaattgaaatttgaggaggagattgttgtaacaagataatttttataggcagaaaaaattaggagaagtgaggaatatgcagaaaagagacttaatccaagcgaatgcttcattagaaaatctacgacagaacttggacatgaaggattttgcaaaagaaatattacttgaggagaattataataaatttataagatcatacaaatttacattttggtttcaattaatcggtgtattagctggatttatagtgccatcagttgttcttcttgttatttttaaagaatttatttactgtgcttttggtgcaactataggaattttttggatgtgtgtatggatgctgctaagtatggtaattcccccgacaaggatatatcgaaaatttgcaaagtggtataggaaaagcgatgtgtctatacgcgacttggatgagatattttattgaaggggacagaaaaatagatggagatgaaaaaggaatctaatatattgactgaggaagaacccaaatacataatatcgctaaagaagagatatagaattcttgtcgaattaagaaaaccggtatttgtggaggaggaattctgtaatgagattttttgaaaatacccgtaagccacaaggcttcggcggaaaattgatgacgaagatgatgaacagcggtcacgccaaattatcgcaatggggattctcaaatatctccgcaaagtctgatgctgaagttctggacgttggctgtggcggcggagcaaatattgcggtctggcttgatagatgtagaaatggccacgtgacaggaatggattattctgaggttagtgtggcagaatctcaaaaattgaacgccctcgccattaaacaagggaaatgtaatgtagttcaaggagatgtatctgctatacccttttctgacgcgacttttgattatgtttctgccttcgaaacagtttacttttggccaggattagtaaaatgcttttccgaggtcaaccgtgtgctgaaaagcgaaggcatattcctgatttgtaacgagagtgacggaacgaatgccgcagatgaaaaatggacaaagatgatcaatggtatgaagatttacacatctaaacaacttgttgccgctttgaaagaagcgggttttacagagatcaaaacgtattcaaatgcaaaaaatcattggataagtattgttgcaacgaaatagccaaatttgaatttaacaagagaatgtggttgtatgaaaaaatccatattagtattttgggcaatcgtgtgtctgttacctattcaaaggaggtttaagaatttcaaatgaaacatataagaaatatattgctgttgattacgattatttttgcttttgttatgcaagctgaagtatatcaaaatatgctctggaactttaatggtgcttattatttatcgtccagatacacaactactaatgacgatatggattcatttttagccaatgcagaagatacagctgagaagcatggtgttcatattttttcgacttttaatcagagagtttctaattatcagacaagactttatatttatggtgatgataccgttgttcgggatagtcttaaaagcacgatgggtattgaggaaaaaacatatacggctttaataggtggaatcaccgtaatagaatttgaagattttagagaagtaaaaaacacaggcaatggacaggaaataatggtcagctatatcggtaatgatgatgacattattgccacatatcaagatttggcaaaagaatattctatatcgcagccagagttttggcaatcaaccgaaactgatatgatgttcattgtttggggcttggttgccatattgatgattgtacttaatgtgattgaggtgatacgcagacaaaaggaagtagttgtacgagcttctctgggcgaaaatgctgctgtgattgctctaaaagctgtagtggctgatatgatttcatatgctgcattattcgttttagcaaagttgcttgtttctcaatttatatcgggagcgtatgaagatcatctcattttggcagtgtattgtgccggagcagttctttccgtaattccttatgctgcttttgtccgctttgatgtaaaaaaagcctttgccaatgcttcagataaaaaaggtatgttttatcttctgaacggtcttaaagtatttgctactgctatgacaatttttacaataactacaaatctcagtagcattcaaggtaatttacttacaaacacgactcttttagaaaatcattataatgattattattttggagttatgcagattgaacctccttttgaagaaaatgaggaggaatccaaagagagcaaattttggaatgacctttacgaaaatgaatacaacactataaatccggtggtctgcataggcagccggataagcgatacggataattatatttttgtaaatcataatgccagagatatgctacaagggttttctgatatgcttactgaagatgatgaaaaagaggatatcgtggtcttcgtgccaaagggaagaaatgcggaatcatacaaagatatcgcaaaagaggaaattagctctcttacccaaaatgcagaagaactgcgtgttgtttataaagaatattctggcagagagcaattttattatctcaattcgaacagagaagaggctattgacggattgtcaagagtaacaaatccgattgtgatttatcaggcaaatgaggctgttgctttaaatggaagttatatcgaaacaggaacatataatggtgaggtaatctacggatgcgatgaaagcacaattcgtaatgctgcgaaaaaatatgcagaacagcttggttcacactattttatgctgacgaatgtcggagaggattacatttatagtcatagtttccttgtaaaattgattagctttataagctctctttgcgtattagtattgctgttagatatcgctatcatcgtatctgaagcgaaaatggaatttagacttagctctatggaaatctccctcaaaaaggttttaggttatagcttttatgaaaggcacaaaagatttatttccgttaatctcatagaaaatatagccgttgtgatattgatttgcattgtttcgatttttatatctaacgcaagtgtcgggattgctttactgattggatcattgctcaccattattgaaatggcaatcattttcacaaatattatgtgggttgaaaaaacaaatatctcaaagtcattgaagggaggatgtttatgattataattcgtggcttaaataaagcatttggagagaaaataattttctccaactttaatttggaaattccggatggaagttttgtagtaatcagcggggatagcggcagtggaaaaagcactttgctcaatatgattggtggtatcgaaaagccggatagcggcagtatcataatcgaagggctgaatattacccggcttaaaaataaaaacagtttttttgcggatacagtggggtttctttttcagaattttgcactgcttgaaaataagacagttaaagaaaatttaagtttgattaaaaaatcaagccgaactaaagtatcacttaaagaagctcttaatcgtgtggggttatcaaaggaagttaacaaaaaagtttatcagctttccggtggtgaacaacagagagttgctttagctcgtcttatgatgaaaaaatgttctgttgttttggcagatgaacctactggctcacttgacaagaaaaatagagatattgttatgaggttattgcacgaactcaatgaagaaggtaaaacggttatcattgttacccacgatcagagtattattgaagatgaaccttatgttgtgaaaatctgagagtacctcttagaaatgtcttgatctacattttatgtaatttgggtcagaagaaaatccctttaggaactaaagggcgcacttctatactctctgtcgagagtagtgcgtcctgcggagcttcattctctgtcagcagaaaaaagctgcatgaccgagaatgttgcgtcactttgttccgtcaaggtggctacacccccttgcgccgctaaagcgactatcccctgtgtacttgccgtccgcaaacggttttgacaaaccgtccgccgccagcaagtttgaaagcgactaaaatgaattttatggaacaaacaaatcggtagttgacaaaggagttgagctgatatgaaaaagaaaatcatcatattgctgtctgttgtgataattcttttgattggcattgttgtatggtttaatattccactcgacttgatggacttagaccctaatgaggtcatggaaatagttgttttcaatggcaatagcggaaacgcaacacatattaccgacaaagagcagattcagcatattgtcgaaaatttgaatggcgtcgaagtaaagcggtcaaagccatctttggaatatacgggatatagtttcaaagttactatttatttgtctgatggcaacgaggcaggcgattggaataattttattatcaactcagatgatacaattagaaaagatccgtttttctattctgttacaaagggaaatattgattacagctatattgaaggtatcgtagaataacaaaaattcaagtttgttgaattaaaaatgaaataaagttccagtaatcatagagtgtatggattcaattccatatgctctttttctttacttaatttcatgaaaaatgtaaaaatctaatgttacgagttgcattaaagaaaactcgtaagaaaaaaagtaaaaaaatttgcttttgaccactgtaaaacatgctctgagcgtttcgttatatgaagggataatttttctttcatatttcaaagaaaagaggataaagaaatgtcagaaaaaagatgttatacagttcaagagttacaggaaatcttaggagtcagcagacctactatttataaccttttaaagaaaaaggaattccggtggatccagttggatggcggaaagtatcgcatctctaagaagagtttcgatgactggctcgataacttggaacaataaaaaacagggtgttgatcaggcagattttgtctgcaatcgacatcctaaatttttatctggatttgagatatgatataagaaaaaacactaacactaaaaaagacaggaagtgaagaataaatggcaacagcaattatgaaacaaaaagaagttccggaaatggacgatgttgaagagatcatttcaaagatatcagaagacagtccttacaaacggcgtccggcacaaaagagaacctggatgaccgtgccggaaatgggaaagctgctgggattaaaaaagacagatcgatactggctggtgcataaaaatgtttttgaatcgaaagagattgccggaaagatacgaatcaatattgccagctttgaaaaatggtatgccaatcagattaaatatcataaagttaccggagaggaaccggggaaagaattaaaatgctggtcctattccgttaaggaagtcgcagatctgctgggagttgatgattatcttgtttatgaattactcaagaaaaatcaaatggaagctgttattgtcgattactggaaacgaataccaaaagaatcttttcagaactggtataaaaaccagtcccggtatcgaacaaaggaagacagagaaaaagacgcccttctggaagatgcaactattacgatgcctgagatggcacagctgcttggaacaaccagaagcgcagtatatacaattcttgataattcaaagtatagtcatttttttgaattcattgtgattgcagaaaagaaaaggatcacaaaagagagttttcaaaaattcctggaaggtcaggaccggtataagctggatccatcgaatgattatgaagaacttgcacaggaacaaaatattgtcctggctaatttccggcggaagaaattatcacaaaccggaataagaggaagcaatggaaatataaagtatcttacttttgatgaagcttcctatctggcaaaggtcagcagaagcatgatcaacaagtgggcggataaaggaaagttcacagtaataaaagttggcagtcgagttaggatccgtcgggatgaatttgaagactggatggaacaaagagatttggaaaggagcatgcaataatatggcatcaataagagaacgaaacggaaaattcaatgtaatctattcttatacgaatgaaaaaggtgagaggaaacagaaatgggaaacctatgaaacaaaagccgaagcaaagagaagaaaaaaagaaattgaatataaaaaagagatgggatcatttgtcgttcgtaaatgcaaaacactggatgagcttattacagaatatgttgcattgtatggaaaagaaaactgggcactttctacatatgaaggaaatgtctctcttatcaataactatatccttccagtcattggtgatgcaaagctgtcagagatcaatacccgattcatcgaaagatattatcagagtcttttgaagaggcgtgctgttatcaatccattaaataaaacaagtagaaatgaatttgtatcatccagtacagtcagggatgttaataagctgcttaggaactgttttgagcaggcagtgaaatgggaattgatggagaagaatccctgcactcatgcgactgtgccaaaacataaatcacaaaaaagagacatctggacagcggatatgcccagtaaaaaaatgataagaggcacaagtgttttctttttcacttggttcacctcattttgtccatgggaattattataataaagcattatatcacagaagttgaaaaacagaataagttttatgaaaaaacggactgtgcataatccttatacatgaaatgaaagaaatccttgctgatgaagtcgatccaaaagacaaaagaaacatattatgaacccctcaaaccaaaccctcaagtttgcccctcaaaccattatcaatgaaacggatcaaaagctctgttctttcatgagtgaaagtctgtatacacgtctgccggtttcttcataatgctgatccagaagatcacaggttgtctggagatcgttaatccggattgcctccaacagacattggtgtgtccatactgcagcgcttccgttataagaggtattttgatccggtgtgtttggttctaagcatttggcattctgaagcgtttcagcatctccgcttaactgtccaaagcgattagcattttgaaccgagaggaacatggcaccattcagtggactcagcagctcccacattttggtcagtcggttaagctgggcagaacgaatgatctgcaagtggaatgtctcatctgcacgaacagccttcatagtattaccttcgagaatagcctttcgaaattcttcaatactggcttccattatcatgagactatagtcactaaggaggcagttacttttttggattgccagtttttcaaggctgccgcgcaaaaaaaagacttcataagcgtcttgtggagaaagcagtgcgactgtacatcctttgttaggacagtaatcgactaaaccttcgacggcgagctgtcggagtgcttcgcgcacaggacctcggctgagtccgaatttccgggcaatttcagcctctaccagtttttcttgaggctgaaggattccattgatgatctgctcccgcagagattcaagaacaatttctgatgtagtagtatttgatgtttttcgttgtttctgcatatttacctcataaaattttcagaataagtatccgttttcgataggtacgcttggttcatagtagaacataccgccaatttctcgcatgtttcattttcttactaattaatagaaaaaattatacggatgtcttttgtccgttagcaaaaaacttattataattatagtggattgttagcaaaaacgaaagcactattttcccgctgttaacattaagttgaaattgttgacaatcatatttgcatggactatacttgggttatcaagagtagctcaaaaattctgcattgtcataaaaaaatcctaaaggggaataggaagcaacgcagtaattgatggatgtcggactgtctggtttccgaatagtccgattttcagcagagaagaataattattataggaaggagaaaaattatgagacttacaaatttgacttggccaaaagcccaggaatattttgaaaaaaatgatatggtacttatttctatcggcagtattgagtgtcacggtcgtcacatgccacttggaaccgatacactgattccagaacatttgttggaaaaaatcgagaagaagagtgatgttttgattgctccgaccattccatatggttcctgccagtatttagctccgtatccgggtacaattgatattgacaatgaggtactctatcaattttgccgtcagatttttctgagtctgtatcgtcacggcgcaagaaaattcgttttcctgaacggacatggcggaaacatcaagatgattgaacgccttggcatggaattcgaagataagggctgtctggttgctatgcttaactggtggctgatggcatgggatatgaacccggcgtggaaaggcggtcacggcggtggtgaggaaacagctgcgattcttggaattgatccgtctttagttgataagaatgagataggtggtgaacttcagtttaagcacctgtctgataatctgaagacaaccggtttccattctgttgagttcaagggagttaacgttgatattattcgcaatactccgcatgtaacagacaacggctggatcggaccggatcatccgagtaccgctacagaagagtggggcaaggaaatgcttgagactacagcaaactatattgttgatttcatggaagagttcaagaaagtaaaactttcataaagaggtgtcataatggataaaaaaacaacgctggaaatgattgcagcaatttcaaatgcaaacggtacatccggtttcgaagatgaagtggttgcagcgattcgtccttacgcagaaggactcggagaaattacagaagatcgcatgcgcaacctgtatatccgccgtaaagaaaataacggcaaacgtccggttgttcagcttgacgcacatagtgatgaggttgggtttatggtgcaggctatctgcccgaacggaactcttcgcatcattcagatcggaggttgggttaaccacaatattccggctcataaagtcttggttcgcaaccggttcggagaatatattccggggcttactgccagcaagcctccgcatttcatgacagagcaggagcgtaaagcacctctggatatgaaagatatcacggtagatgttggcgctgtttctaaagaagaggcggttgaaaagttcggcattcgtatcggtgaacccgtagtgccggatgtgacatttacatattcagaaaccacagatctgatggttggcaagagctttgactgccgtctgggatgtgcggcaattcttaagactatgcataccctggctggtcaggagctaaatgtggatattgttggcgcttgtgcagcacaggaagaagttggtgtacgcggtgccactgtgacagcacaggtaattaagccggatatcgcaattgtttttgaaggctgcccggcagatgatacctgcgttgagtcgtatatggttcagacagctatcaagcgaggaccgatgttgcgtcacattgatgcccgtatgatcaccaatccgcactaccagagatatgcgcttgatttagcagaaaaacttggcatcccggttcaggattcagttcgcagttccggttcaaccaatggtgcggctatacatctgactgaaaaagcagttccggtcatcgttatcggtgttccggttcgctatgcgcacacacattacggaatttcagcttatagcgactttgataacgctgttaagctggcatgcgaaattcttaaaagacttgacgaagagcaggttatgagtttttaaatacaatacataaaagaaacaaagcattttcgagacatactaacagagaattgtattgctacgcttgaatgttacctaaatcataaacaaagcattcggaaaacctcagagctagcagaaggttaaacatggaatcctgataaataggaatacaccaaaaaaataggggctgccgcactaatgcgacagcctcatttagcatacatcttcagtaaatgaattattcctgatcaagtatggactgaatttgtttcattaattgctcgtagtttgattgatcatcgattccgcccatgaaaggttcgccaacgatatttccgtctttatctacgagaactgttgtcgggaatgccataatgtttcctgcatattttccaactgttgaatcggagtcgaaagtcaggtttttgtaggaagctcccttggccttcaagatttctttcgcttctttgataccatcctgattgttatctaatgtatctgtattgataccaacaacttcaccgcccatttccttaattgtatcatttaattcattcagtttagaaagttcttcaacgcaaggcttgcatccactgaaccagaagtttacaaccgtaactttatttttggcgaaaaggctttcatctacatcgttaccatccaagtctttccctttgaaaccgtgaaacacacctgtagagtcatctgtgccggaggaactactgctggaagaatcagttgcggcaatttctttttcaagttttgcaatttcttcttcaataccgcggatcgtttcaatgtctttactcagagtagcatattcttcttcggagaaagaatctttgtttgattctattatatttgcaagaaagtccgcatagttttcattcttggtatcatcgtcaatgttcttgctcataaagccaaatgctttgtcccacacatctttgtgatctgcaaagatctggttttcctgttggtaaaggtcattcagcttttcattcagatcacccgaactgcttgaatctgttgtggaagtatcttcctgctttgagctttcagttgttgcggaaccggatgaagttttgcaacctgtgaatgcaaaaagaatgaaaacggcaagagatgccgcaattactttttttaatttcattgagtttgttctacttgttttgtttttcatgatttttaatctccttttgaatatcatttgattcatttttgcttatttattgtcagcctgtttcttgcctgaaaatccgtaatgatagcagatcgcatttgtcggacaggctttcatacatgctccacatcggatacattccgggtgatccggtgtgtctactacatttacatccattttgcaggcatggctgcatttttgacagttaacacatttttcaggatccaccttaatcttaagtaatgatattttgttaaacagcgagtagatggcaccaagcgggcagatccacttacagaatggacggtaaaacaaaatgcttaagataattacaaatacaaggattgtaaacttaaacgtaaataagtgtccgagtgccgcgcggattcccgaattaacaagtgccagtggaattgcaccttcaagtacgccttgtggacatatgtatttgcagaagaatggatcgcccatccccagcgaattagtcacaaatgccggaagcagtataacaaaaacggccagaaccgcgtatttcagataccgcaggggttttagttttgcagtagacagtttcttacccggaattttatgcaacagatcctgaaaccatccaaacggacagagaaaaccgcagataaatcgtcctaacagaactcccagcaagataaagaatccggtgatgtagtaggtgaacttgaattttgatgaaccgactacagcctggaaagctccaatcggacaggcacctgtggcagccgggcaagagtagcagttcagtccgggtacacatattgtttttacctttccctgataaattttccctttaaacagattcggaatatgaagattggtcagcagtgttgcagctgcctgaaaccatccgcggaaacgaaccaggaagttcttgtttgattttaatttcttatccaattccgacacactccatacataattttattgccttactgagtacagttgcagcttctccacggtaaatcccgacaaggaaaaatacaagaccggctgcaagtaaaaaaatttgtgttgctttttctgatttcattaagataccacttgttactgtaaatagtaactgctcctttcaatgttattgctcaaagtcggcttattgaccgttcagtgactacattatataatatgggatgtaaatttcctgttaagaaaatggagaaaagtaaattgagattattagttgttgaagatgaaaagaaattatgtgatatgattgcgaaaagtctgcatctggcaggttatgaggtggacatgtgtaatgacggagagcaggcactggagatgatctatgcggaactgtatgacctgatcgtgcttgatcttaacctgcccggggtggatgggatggagattcttcgggaacttcgcaaagaaaatgaagagacaaaagtattgatcctgtctgcgagaagtcagatcgcagataaggttgaaggattggattccggtgcaaatgattatatggaaaaaccatttcacctgcaggagctggaagcgcgcgtgagaagcctgacaagaagaaaatttatacaaaaaaatatctgtctggaatgcggaaaacttcgatttgatacgagagaaagggttgcatatgcagacgataacccggttgcgttgacaagaaaagaaaatgggattttggaatatctccttttaaatcagggaagaccggtcagtcaggaagaactgatcgagcatgtctgggattcttctgtggatagttttagcggttccatccgagtacatatgtcttctttgagaaaaaaactgaaagcaggactcggatatgatccaatcgtgaacaaaatcggtgagggctataagataggaggaaatagcaaagcatgaagaaaatatcactccagtggaaattaacacttcttacaaccgtgttgatcaccatattatgcggatgtcttacctttttcttatataaaaacggagtctattatttcgatacgcttcaggagtctatcacggatcagggcacagagccggaatcggtgtacattgatattccggataatgagtgggatgactttgtggcacagttttccatgaaggtttataactccaaatcagattatagaagcagaagccttctgattactgctattgtagcgctgtttggcggcgcagcgacttattttatcagtggacgggcattgaaaccacttaggaaattttcagagacagtggaaaaagttcaggcacagaatctgaaagattatacgatcgaagagaataagattgcagagctggacagacttcgcatatcttacaataagatgcttatacggctttcagaatcattcgagacgcagcgccagtttacgggaaatgcagcacatgagttacgtactccactggctttaatccaggcacaactggatctataccatacaacagaacatccggagagtaccgcagtggcagaagagacaattcagatggtaacggagcagaatgaacgtcttagcaagttggtccgaacgcttttggatatgagcgaattacagaccgtatcgcgaaatgacagaattgagctccatagtctgatcgaggaagtgctgacagatctggaaccgctggcacaggaaaaaaaggttgaactgatacagaagtcacagggagcaggagcaaaggctgatgaagaattgtttttgacagggagtgatattctgatttacagaatgctatataatcttgtggaaaatgcgattaaatataatcgggaaaatggatccgttacggtatcggcaataagggagaagaacgaagttgttctgacggtttcggatacaggaaatggaattgatgaagcattcagggagcagatcttcgaaccgttcttccgggtagataagtcaagaagccgggaactcggaggtgtggggcttggccttgcgatggtgcgagaagttgtgcgggttcatgacggaacgattgaagtttatacaaataagcatagcggaacgacatttgaagtgaaaataggtataggggcagactttgaaaaagcagtataatcgaaaaacaattcgcaaatcgatcatactgatgtttatcgcttccacctgccagaacatggagaatccgtcttacaattcacttaccgtatcaaaaataaactaagaattattatttttgatacggtttaaattatttcagacagacatccataaaatcctgcactaccgccgtcggcttccgccccttctgccagatcagaaggatcttcgtcaccagatccggttcatcaagcacctgacaagtcagcccttcgcaaagcggctccatggactgtgggaagatcgccgtggcaagcccttccttcacccagagggtagcgcccctggcatcatcacacagacagaacacctccggaaccagattctgcgcgtgaaatgcatccataatcagcttttcatagcgccggtagagaattaacggtttgtggaccaaatcttcaagaatgagcgatttccgcctttttgaaggcatctccggattggagacagcgatcatcggctccgaatgcaggactgcggactccacatcatccagccggagcggtgtgcggacaaccgaaatatcgatgatcccttcctgaagataatcatataacgtatacgtgatcccgtcgtgaacctcaaaattcacgtcgggatttttctttgaaaattctgcgataaacggcatgactgtgccgaccgtcgtcggcgtgatcccgattctcagaaccctttttttacccgtttgggacacctcaagctctgtcgatctggcataatccagaaggctcgccgcacggtcatacaaaagcttacctgccgccgtcaggatcacccctttatgggtacgctcaaacagctgcacgttcagttcattttccaactgcctgatctgatagctgaggggcggctgtgacatattgagctttctcgccgcttcattgatgcttcccgtattcgcgatttcccggaaatattccagctgtctgagttccattttctttttccctccgtttagttatatgatgataccagggtcaaaaggtcagaaagccgatgcaagcttgcttgcaagaggatttttgacctcttgacccgccaaaaacatgagtaagtagccatttttcaaagaaaaatgagcggattacgaatgtttttgaggattgcgagagtgcaaagcacgtagcaatctggtatcaaataggtcaaaataccttttgccactcacattgttatactttttttatattaagctgtcataaaaacaatattattcatattgatagtagcgcattataatgagtaggtcaagaaaaaactaagaagtaaagaacaggagtgagtgtgtttgaagaaactttgggtttatctgaaagaatacaagatagaaagtattcttgcaccattattcaaactgctggaagtcgtatttgaccttttggttccggtggttgtcgccaagatcattgatattggtattgcaaacaatgaccacggctacatcgtaaagatgttcctggtgctgatcctcatggctgcagtcggtcttagctgcagttttaccgcacagtattttgctgcaagagcgagtgtcggctgtgcaaccaatttaagacaggccgtatttgaccacattcagggcttttcatttaccgaacttgatacgatcggtacggacaccctgatcacacggatgaccgatgatatcaaccaggtccagaacggcatcaacatgggacttcgtcttcttctgagaagtccgtttatcgtaatcggttcgatgatcatggcatttacgatcaactttaaatgtgcgttggtattcgttgtggcgatccctcttttatttgtcggcgtcattttcattatgctggtcagcatcccgcttttcaaaaaagtgcaggctgccctggaccgcgtcacaggacttacccgtgagaatctgacaggtgtccgcgtgatccgcgcattttgccgcgaagaagagtccgtaaatgaatttgaaaagagcaacaccgaactgaccaggttaaatgaatttgtcggaagaatttccgccctgttaaatccatttacctacgtgttgatcaacattgcaactgtcattctgatcgcaagagcaggactccaggtcaatctcggaaccatgcatcagggacaggttgtcgcgctttacaactacatggcacagatgatcgtcgagctgatcaagctggcttccctgatcattacactgaacaaggcgatggcatgtgcagaccgtgtagccggtgtcctggatatcaggactaccatgcattatccggaaaccccttctgcaaaggcagatccttctgcaaatgaagttgaattcgacaaggtatccttcacctatgcaggtgccggtgcatcaagcctttctgatatcagtttctctgtaaaaaaagggcagacagtcggtatcatcggtggtaccggatgcggaaaatccactctggtcagcctgatctcccgtttctatgatgtaacctgcggaaccgttaaactgaatggacgcaatgtaaaagagctcaccaatcaggaaattcacgacaaagtcggaatcgtacagcagcgctccgtccttttcaaaggcagcatccgcgataacatgaaatggggcaatgaaaatgcatctgactccgagatctgggatgcactgaaagttgcacaggcaaaagaagtcgtagaaggaaaagacggacagcttgatttcatgctcgagcaaaacggaaagaacctttccggtggacagcgtcaacgtcttaccattgcccgcgctcttgtgaaaaagccggaaatcctgatcctcgacgacagcttaagcgcacttgattttgcaactgacgcagcacttcggaaagccctcgcaggactggaaggagagacaacaaccttcctggtatcccagagggttgcaggcatccgccaggcagacaagattttagtattagataatggagaactcgccggatccggtacacatgatgaacttatgaaatcctgcgaagtttatcgtgagatctatttctcacagttcccggaagaccgtgcaaaatatgaaagaggggagatgtaggtatgaaaaaagacagtgtaatgaaaaagctttttaaatatatcggaaaatactggattctcctgatcctcagcatcatccttgccggaatatcagtggttcttcagctttatgtgccggttctcttcggtaatgcgattgatgagatcgtagcagcgcacaatgtagactttacccagatgtggctctatctgaagcagattcttctgttcgtagtgatcgctgcagccgcaatctggatcatgaaccttgtcaataaccgcatgacctatcatattgtacaggatatccgatcccaggcaatccgccacatccagaagcttccgctttcttatctggaccagcacagcaccggcgatattgtgagccgtatcattgccgataccgatatcctttctgacggattactgctcggatttacccagttattttccggcgttgtgaccgttgttgtaaccttgatcttcatgttttccaagaacgtgtggatcactttgatggtcatccttctgacaccactcagcttcctggtggcaaaatttatttcctcacgctcttttaccatgtttaaaaagcagagtgaaacccgtggaaaacagactgctctgatcgaggaaatgatcggaaatcagaaggttgtcaaggcattcggatatgaggacaaggcttcaaagcgttttgatgagatcaataaagaactcaaagaatacagccagaaagccgtattttacagcagccttaccaatccgtccacccgtttcgtaaacaacattatttacgctgccgtagcgcttgcaggtgcattcctgatcccgcttggagccctgactgtcggcggtctttccgtactgctttcttatgcgaaccagtacatgaagccattcaacgacattacatccgtaatcacggaaatgcagaacgcccttgcatgtgcgacacgtatctttgacctcttagaagaaccggaagaagtaaacgattcttctgaagtacttgaaaaggtggatggaaatgtggatatcgaccacgtagatttcagctatgacaagagtaaatctctgattgaagactttaaccttcaggttgaacctggtatgcgtattgcgatcgtaggtcctaccggatgcggaaaaacaacatttatcaacctcctgatgcgcttctatgacgtggattccggaaaaatctgtatcgacggtaaaccgatcgatgagatttcccgacattcgctcagaaagagcttcggtatggtgcttcaggatacctggatcaaatccggtactgtccgtgaaaatatcagcttcggaaaaccggatgccacggatgaagaaatcatccgggcagcaaaagaggcaaaaagctgggatttcatccgcagacttccacagggacttgataccgtcctgcatgaggacagcatcagccagggacagaaacagctcctgtgtatcacaagagttatgctctgtctgccgccaatgctgatcctggacgaagcgacttcaagtatcgatacccgtaccgaactgcaggtacaggaagcatttgataacctgatgaaaggtcgtacaagctttgtcgttgcacaccgcctgtctacgatccgcaacgcttccctgatcctcgtcatgaaagacggtaagatcattgagcagggaacccatgaagaactgctgaaagaaggcggcttctacagtcatctgtataacagccagttccaggcagtgtcataaaaggataacggtgctggagcggattcgtcggaaacatccaaaacagttaaagatggattcatggaaacaccagatggtgagattccatttgattaattcagaataaatggttggagaggctgccctttgccggggcatcctcttttccattttacagaagaaatcaaaaattacaggtattcgacctaacgaaatcgtgatataatgagcgcaagagagccaacatgcttgcatgattggcgaacggcgaattggatcatgatagttgcgaagcaacggtcatgatataatcaaaatatatttgaatgagaaatatggagatagcttatgggcgtaagttataacagattgtggaaaatgctcatagataaaaatatgaagcggatagagatgcagtacctcactggaatcagtggaaatattcttgcccggatgaggaaaaatcagtatgtatcaatggagacgattgagaagatctgcaagaagctagactgcactgttgatgagatgatggaatttacagataatgagtaacaggaggttgctacaatgacagatacacaacaaagagcagcggcgaaagcatttgcgaaaaactggaaagaccttggatatgaaaaaggagacagccagatattctgggtggagcttctgacaacggtatttggtgtgacggaaatatcacagtttatttcctttgaggatcaggtacaccttgaccataccagttttattgacgggtatattgagaaaacccatgtcatgattgaacagaaaagtatcaacaagagcctaacggctgctatccggcagtctgacggttctatgctgacaccatttgaacaggcaaaaagatattcttccgaattgccatattcaaaaagaccaagatggattgttaccagcaatttccagtcattctatatttatgacatggaaaagccgggcggtgatccggagattatccagttggaagacctggaaaaagaatattatcggttacagttccttgtggacgagggaaacacaaatcttcagagagaaatggaagtttccattgccgcaggtgaaattgtagggttgctgtatgatgcactggcaaaacaatatgttgatccgacaacagagcgggcaatgaaaagtctgaatatcctttgcgtcagaatagtattctgcctgtatgcggaagatgccggcatctttggacagcatggcatgttccatgattatctggaagagtttgacacaaagcacatgagaaaagctgtgattgagctgttccaggtgcttgatacaaaaccagaagccagagatccatacatggaagaatccctggcacagtttccatatgtaaatggtggtctgtttgcaaatgaggatattgaaattccacagtttacggatgaaatcagaaatcttttactggaaaatgcttcagcagattttgactggtcagaaattagtccgactatatttggtgcggtattcgagagtacactgaatcctgagacaagacgctccggcggtatgcactacaccagcattgaaaatattcataaagtcattgatccgctgtttttggatgatctgaaaaatgaattgaaagaaattcagcagataacagttcaaagaacaaaagataaaaagctgagagacttccagacaaagttatcaaatcttcggtggcttgatccggcatcgggaagtggaaactttcttacagagacatatatcagtatccgtcgattagaaaatgaagtcataaaagaattgcagagaggacagattacttttggcttcgatgaatcttctccaatccgtgtttctattgatcaattttatggaattgagatcaatgattttgctgttacagttgccaagactgctttgtggattgctgaatcacagatgatgaaagagacagaagacattgttcacatgaatctggatttcctgcctttgacaacaaatgcgtttattgtggagggtaattctttacagattgactgggagagcgttgtaccaaaatatcaggtctcgtatattatgggaaatccaccgtttcatggatttacttttatgacagctgagcaaaaacaagatatgcaaaatatttttccaggtgtaaagaatcttgattttgtttgtgcttggtataaaaaagcgtcagactatattcggggaacaaaaatagaagtcgcttttgtatcaacaaattcaattgttcaaggtgaaacggtatccagattttggaactttatgcaggatgatattattaactttgcatatagaacgtttgtatgggatagtgaagccagtgtaaaagctcatgtacattgtgtaatcattggatttgcgaaattttcacgttcgactaaatatttatacgataacggaagaactacagtggctgaaaatatcaatcgttatctgatggatggagatgatatattagtacgtagcaggaataaacctttgtgcgacattcctaagatgatatatggcaataaaccagcagacggcggaaatctaattattgaaaacgaggacttggatgaatttattaaaaaagatccgaacgcaaagaaatatatccatcctcttttgggagcatcagaatatatcaaagggaataaaagatggtgtttatggcttgttggagcagatccagaaaatttgaaaaagtgtccaatgattatggaaagaataaagaaatgtaaagaggcgagagaaaatagcgttgcggctggaataagaaaatttgcagctacaccaacactttttgcacagagaacgcagccggttgataaagattttatcattgtgccgagagtatcttcacaagcaagacgttatgttcctatgggattcattaaagctggaacaattgtaaccgaccttgttcagattattccggatgcatcactatatgaatttggagtaatcatctcaaatgttcatatggcatggatgagaactgtgtgtggacggttaaaaagtgattataggtacattaaagatgttgtatataacaattttccttggccagagccaacagagcagcaaagacaaaaaatagagaagacagcacaaggaatacttgatgcaagggcactgtatccgaatagcagtcttgcgatgctgtataatgaattaacaatgcctccagaactgagaaaggcacatcagaaaaatgatatggcagttatgcaggcatacggattcacaaaagggagtaaagcctataaaagcgaagctacttgtgttgcagaacttatgaaaaaatatcagaaattgtgtgaggaacagaaatagtaaggagcagaaaagttgaaaaataaaaacactgagaaaacagagtttctaaaaatagtatattttgatgaagctgctgcacaggattatgttgatgttacaaatggaggacgacttgattggtcaacacaggaaaataaagaaaaaatagctaaaatagttgctgaaattgaagctcaggcaaaaagtggctttaatattttgaattatattaaagcaacatttcagggaaaagttgatgccagtgcttccgctgaactgaccactgcttttgaccaaacaataaaaaatacgttgcttacagattacatacaggcagcatcgaaagatgaacacgtaaaaaaattcgagaatagtggtgtttatgctccggaaaattctgtgacattatataaaatgctcagttcatatttgactattgtgcctaaagaagaaatgccaatagatatggaaaaattaaatgaggcaatattaggtgaacggggttattatgatatgctgttaaagacagagaaagtgcggaaaagtgtattgagatttaaccttcaagcatttaaaaataattataaccttgtcgatttaagcaaaatgaagctgacatatttcggaataaaggttggaacttgtggcgaaaatcatttgtcgattgataaagaatttgattttcaaccagcagaagacaagactacagcagaagaaattgtagagggagaaaagtctgctcctgaagaagaaaaagaattagatgtttatgatatagtattggcaggtgtggtacgtgaagaagattgaaatttttgtaggatctgattctgcttttgaaaagattgttccgaaaagtgcaagaaatcttagtgaaatggcagtgaaacttgatgatggtaataaaaaaatagatatgtttgttaacattccagggcagccagaaccaaagcctaagaaaaagaagaaactgagagttcaggattttgttattcatgcagatgagtactgtagtgttcaggaacatgtaattataaactttataaattttattttccaaatgtccataacaaatatgtacattcaaaatccaccgaaaaatattcgagagcagatatatagaacatttaataaaagtattattcatgaaacacaacagccatatttggaagtttcaaaagaaatgatacaaacatttaactgccaatatagtgaaagggtaattggacaggaaagagcaaaaaagaaattgcttcaagcaatatatcctctggtagatggtaaacaaagcaagccggttgtaatattgttatatggggattcaggacttggaaagacagaatccgcacaatatatggcagaattgatgggtggaaaattattaagaaaacaattttctatgtatcagaataatgagtcggccaattatatttttggtggaagatataacgaaaaaagctttgcacaagatcttttggctagagaaactaatgtattgctgtttgatgagtttgataaagctttatctatattccatagtgcattttatcaattatttgatgaaggaatttatgaagatcataattataaagtggtagtaaataaggcaattattatgtgtacttcaaattataaaacaattgatgagataaaggaacacttaggattgccgatatataatcgttttgattcaattattaaatttaatgatttgtcagatatagcaaaagaaaaaattgcagagagggaaatagaaagactgaaggaagattatgatattgaagacagagagctatttgacaaaataaaaaaaggtgcagttagtcagtcaaatgcaagagaaataaaacgtttgataaaagatactttctctcttgtggcacttaaaaaaatatgtggtgaaacagaaatataattctcttagcaacgctacgagcgcacttctatacatgcaatttcatctgcctgtatcgtgcgacctgcggtgctgctcacggttttgagaaatctcaatctggaaaatacagcgaaatcagagatttcgtacaaggggagtttccccttacggcacaagtgcctatccccgataaagtttgtggctgaatatttcagatacagacatataaagtgatagaaagcgtgaaatataaatttgaagggtgacaatatatgaaatatttatatttgcatggactagggcaaaaaccagacagttggaatagagtaataaaagaaacgaaagtatcgaaaagcagtcgcagtttgagtttatcagagatgttagaagggaaagctgccacatataaggaattatattcagcattctcatcagaatgcgacaaggagaacgaagaaattgtcttatgtgggctttctctgggagctgttttgacacttaattatgcgatagaccacccggataaagtaaaggcactcgtattaattgcagcacaatataaaatgccaaaaaaattattaaaagttcagaatatgttgtttcatcttatgccgaattcggcattcaataaaatgggcttcaaaaaagcagatgttattaacctatgtggtacgatggctgaattagatttcagcgactcacttcataaggtgtcttgtccggtattaatcgtttgtggagagaaggacaatgcaaacaaaaaaactgcaaaagaactttgccattatttgaacaattccaacttccatgaacttatgaaaacaggtcatgaagcaaacatagaagctccggaagagttggcaatcgtgttgcaaagattttatgatagtatcaattaacttcccgtttatcgggaagtcgcagagaacgaaaaaacggtatttggaggtattcactatgaaaaagattataaccgtaatgctttgcattgtgctggttcttctctttgccggatgtggaaagaacggcgatacatcaaaagtggaaattgattatggagcatcttccgtttattcaaaagaagaaatagactctgccattgagattataaaaaagcagttcgcttcgtttaagggctgtgaattgcatagcctttcttatatgccggatgaagaatgcaacaatgcagataacattgaatggatgaacaatttaagaacggatgataataaagaagcctttacgcaatgtattgcatttgaaagcagtttccgttcgccggaaaaaggtggcggtgcatgggaagctaacgaagaatacacttggtcatggtggcttgcacggagtgaaggcggagaatggaatctgatgacttggggttattgataagagtagaaaattccagtattattgaccaagaaattaaggaggattcattatgagtgagaaaacagagattactttcatgcaaacaagattaatccggcttgcttcagaagagtggcatttacctgttgaacagattatcctcttgtttaaagaagccgatgttcttggatatatagaaaaatgctatgggatttttcattgtgaaggtgatgaagctgtgcttgaagatattactgaatttttgcaaagaaatggcaaggtatgatatcattgcagggaagattgcggatgatgcgacaaatgcaactcttacagcctaccttgcaggggctttcgggacagcaggtgatcaggaagcagatgatttttgtattaaacagttgctgccaaataaattaaaagatcaatattgctttaaaacggaagcagctattgagtgtctaaaatttgtgaaaggtgagaagatatggctgaagtaacaattccaaaagaaaaactggattatacaatcgaccttcttatcgctatggtgacagaagaaatcgcagaagagacaggcaaggacagaaaagaggtattgacagattttctatgttcaaagacaggaaaagcactgtatgatgagaaaacaaaactgtggtgcaatggtccggcatatataaccgaattgtatagggaagaattaaagaaatcctgatatggaatgtgagtttaaatttatacaacaatggcgatcaaaacttttattccatatagagcaacaattaaacatttcaaaaacgctgaggtcagcatttcctaatcatggaacaatgacctcagttttttataccaggaatcggcattcatgaatcagccggttctttttatttctccagatacgtgtttttgtattcttcacgaattgcttccggcacaagacttccgcctgttgcccatgcaatatgtgtcgcatttttcattttctcttcaagatgattctcctgtaaatatttacgtgcagattcattcctttcaatctgtattggtccttcaaaagaagcacaagcacttggctcaagaaaaatgttctctgttccgagaaggtctctcatgtaatcatataattttccatcgcggatagtaaattcgccgccaagcagattcttcattactctgcctacaaatccagaaggacgtcccacggcaagcccatctgcatgggtaagtccggtaagcccaatatcctgtacggaaatctcctggttcagtccggttgccattccgactagcatacacggtgcctgtgtcggttctatgaaaaagcagtgtacataatctccgaacagcagcttaagtccaaagcatacaccacccggtgctccgcctactccgcagggaatatatacaaagagcggatgtacctcgtctactgcaacattcttttcttccaactgcttttgcagacgttttgccgctactgcataaccaagaaagagtgtttttgaattttcatcatccacaaagtagctgttcggatctgcatcagataaagcacgtccgtttttcaccgcttcactgtaatctgactcatattcctttactgttaccccgtggcttctgagcaagtcttttttccactgtttcgcatctgctgacatgtgtacgatcacctgatagccaactgctgcactcatgattccgatactcagtccaaggtttccggtggaacccacctgaatggtatactttttgaaaaactctctgcattcttcactcgccagtttctcataattgtcttccagactcaaaaacccatgctctaatgcaagttcttctgtgtgcttcaaaatctcataaataccgccgcgtgccttgatcgaaccggcgattgccagatggctgtcctgctttaataataagtttccttccagattgctgtcgtatttctcattcagcaaatccttcatcttcggaaccggtgtcagaacagattcaatgattccgtttctctcctttgtttccgggaaacatttcataatgaacggtgcaaaacgctccagtctgcgctccgcatcttctacatcttccataccaagttcgatctgttccattgcttccccacaaactgttttgtccggatttttccagaacacctctttttcactacagatctccttcaagatcggagtcttttcctctagcattttcaaatcaaccattgctttcatccccctctttccatgacttgattcatatctatatattaccttatttcttgtattatgcctaccacaaaaaaactgtcaatcttaaaaaatagtgttataattaaaatatgtttaaaagaaacggggtaataaacatgggaaaagaaagatattctattttattcagcagcatgacaggcaatacaaaggaacttgccgatgcgatccgcgaaatacttccggaagaaactctcgattattttggcctatgtaaagatgcagatccgcagtcagaaatactctatatcggcttctggacagacaaaggaactgctgacgaagcgacaaccacactgttaaaatcacttagaaataaaaaaatcttcttattcggaacagccggctttggtggaagcgaagagtattatcagaaagtacttcacaacgtacgtgaaaatattgatccgagcaatcagatagtaggagagtatatgtgccagggcaagatgccgatggctatgagagaacggtatgtgaaaatgaaagaagatccaaaccacaaaccaaatcttgatatgttgattgaaaactttgacagagctttatctcatccggataaagctgatttagagaaacttcaaaaatctgttttaagataaaagaaaaacgataccgcagaaactcttatgaaagaatttctgtagtatcgtctttttttattcttctaccttccactctctggtatcaaagatgtgaagatgcagtgcttctgaaatatatcccaacaattcgcagcctgcgatacagtttccttttttgtcaagagatggtccgtagatcccgattcccattttctttttcgacacgctgaggagacctccgccgactccactcttagtcggaattcctgttcttaatgcaaattcccccgatccgtcatacattccgcaagtaagcataatggtctgcaccatccgcacagtttgagatgagatcagacgttttccggtggaaagctgcactccgtcatttgcaagcagaagaccgaaccttgccagatctcttgcatttaccgacatggaacacatctttgtataaaaggtaacactttcttctacatcggtatcaatgatgtccttactctttaaaagataggcaatcgccttatttcttgcgcaggtcgccatctcagactgaaatacggcttcgtctatcgcgatctccggatcttcgcatacttcctgcatatacttctgcatatcttcgatggaataatggttcactagcagacttgcaaccgtaattgctccggaattgatcatcggattaaagggccggttgctccggttatccagttctaccagtgagttaaaagcctctcccgacggctccacgcccacatgatcaaacacaaactctgctccaaacgtttccagcgccaaacacagtgccattactttggaaatggactgtatcgtaaatctgtcctctgtatttccggtctcaaattgattgccgtctattgtgtaaaggcagatcccaagtttattcttatctgccttggcaagctccggaatatacgatgcgacacttccataccggatcacaccttttccgatacggatggcattttccagtattctcgtaacttcttctgatttcatcatattctcctttttcgctcagtcgtaatcccctacaccttctatttcctaagtactaacatacatcattttccggcttcaatcaaccaccattttttgctgaaacccgacggaataagatagacaaaaaagtgccctcattgtatattattagtagtttaaaactggggaatatgcaaaggggaaaatgtatcatgaatctaatttcacaatacaaaggtcttagaaaagaaaactatgtcttatgcttcggatgctttgtgacggccatgggggcaatggtccgtccgatgctgacgatgatcttaagccagaagcttgggatgaatgccgtgcaggttgcctggatcacggcactgatggggatcctgacgatcccggcaaatctgattggtggaaagatggccgatcgttttaataagaaaatgaatatcgtttacctggatatgatttccgtcatttcttatatcatctgcggactgctcccgctgacgacaaaatccattgtgctgatgtttatcgcatcgacctgccagaacatggaaaatccgtcctacaattcgcttactgcggacatcaccctcagcaaggacagggagagagggtattccctccagtatctgacagcaaatctcggcggcgtgatggcttctgctgtagccggatttatgtttcgcaattacttatggcttgcatttttgctcagtggaatttccatcggcacttcttctgtgctgatctatttctttgtacagaatatcacaccggaaaaagaagaaaatgatagcaacgccatttatcaggccgaacgccacggggaaagcctgctgacgattcttaaagaaaaccggcttgttctgctgttcattctgatcaccagcgggtacacagcactttaccagatgtataattatctctttcctatggatctgatccgtctgcacggggataccggtgcggtgatattcggaacagttaccagcatcaactgctttatcgttgttctcttcacaccatttatcacccagatcctgaagcgatcctccgaaccgaaaaagacaatctacggatttttactgacactggtcggctacgtattgttcatcctcttttccgggcacatcccgttctattatgcggcaatggtcgtactgacatggggtgagatttcttacatgctggcggaaagcccgtacatgaccaggcgtatcccatccagccaccgcggaagaatccacgggctgatggagatcatccgtatcggatttatgagtctgtaccagcttttgatcggatttatttacaaaaatcatacgccgatctttacctggatcatcgttcttctgacaggagtcgcattcatgcttctggctgttatcttaacgaaagaggacaaaaaacgctataaaaatctgtatcgaagatagacaaagctgcctatttcagacagaccttcataaattcctgcacaagtgcagacggtttacgttcttttttccaaataaggaggatctttgtcatcagatcgacctcatccagtacctgacaggtaagtccttcacagagaggctgcatagactgcgggaaaattgctgtagcaagcccttcttttacccaaagagtagcacctctggcatcatcgcaaagacaaaatacctccggaaccagattctgtgcatgaaacgcatccataatcagcttttcataacgtctataaagaatcagtggtttgtgtaccaaatcggtaagtgcaagagagtctgtttcattttctgacattgcaggatttgatacagcaatcatcggctcctcatgcaaaatcacagattcgacctcgtccaaccgaaggggagtacggacaacggaaatgtcaataataccttcctgaagataatcgtataacgtatatgtgatcccgtcgtgaacttcaaaattcacgtcgggatttttatttgttgtgatctgcaccccgctccatgcgatttctgcattaatttcctcaatctccgcagtgattttttcgtaaagcttgtaacggaacttttcggtagccttcttccatacccaggtataaaagattaaaccgccttcagccctttattttcaagggctgaaggcggtttctatcaacacattttgtcctataactcccattttcgaatgatatctggcttttctcttcttatacatctcttatcagtctttcgtttccataataacaatccgaccatttacaaaactgatcttcacttcatcatccacaaactggttgctcaccgtcagactgtcgcacggcatcagatcatgatgattgagcggccatttcgtaccctccaaactgaaatcataaatctcgccttccaaagaaaatacagaaagatatggtccgtatgcttctgactttttcagcacacaggatttattcgttacccagattttatttttctcatccagaatgcaggcatttactccggcatcacatgccacactaagtgtctggacattcgcccacaaatgatcgattcttccaccggttgccccaagaaggatcatctctttgcttcccagtgtaattcccagccgaagagcaatctctgtatccgtcgcatccttaaccggattatattcccggatcggaatattcgtctccttgcgatagtaatcaatcacctttggatcaatactgtcaaaatccccaacaatatactgaggctcaatcttatgattatacagatactcaagccccttatctactgcgataatataagcctccggatttgcttcaagaaccttctctgcaaatccctcgtcaagcattcccccactgataatgactgtcttactcataattctttaaaatctccatcaattctcttgtgttttctcctgcattccctttgaatacagctgatcccgcaacaatcacatttgctcccgcatccagtgcttctttcacattgaatgcataaattcctccgtcaacctgaatatcagtctcaagtccacgttcattcagcattgccctaagtgttctgaccttatccagcatctcagaaatcagcttttgtccgccaaatcccggatggactgtcatcacaaggaacatatccacttcaccaaggaattccttcaggacctccaccggtgtatccggtgaaattgccagtcctgtcttcatgccacacgctttgatcttgtccagagtcgcacgtatatccttgcatgcttcataatgtacagtaagaatatccgctcctgcctctgcaaatgcttccacataacggattggttccgtaatcatcagatgcgtatctatcacctgctttaccgccggtttgattgatgcaagcacaggcattccaaaagaaatactcggtacaaacacgccatccatcacatcaaaatgtaaatataccgctccattttcctctgtctggcggataccttcttccagattacaaaaatctgccgataaaatagatggtgataatttatattccattttagtacctccttttttccttctgttccagttcccgatacatctcgcaataatcttcataccgcaccggatgcacttttccctcttccagagcctcttttaccagacaccccggttcactgatgtgattacacccctgaaacctgcagcctccctgatactgatcaaactccggaaaataatatttcaattcttccttgccaaaatcgttggtatacagtgacgaaaatcccggtgtatccatgatataggaatcctcgtcgatcgggatcagttctgaatggcgggtagtatgttttccccgctcgatctttctgctgatacttccggtctccatattgacattttcctgaagacagttgatcagagaggattttccaactcctgaaggtccggcaacagttgttgtctttccttttagtgcgtctttaatctccagaatattttctccttctctggcacttgcaaagatcacacggtacccacaagcctcataagtcttctccagagactcgatttccggctcatctgcaatatccttcttgttgaaacagataataaccggaatctcctgccgctccatcataaccagaaacctgtccagcagattaaaatgcggatccggcttcttcactgcaaatacaaccagtgcctgatcaatatttgccactgccggtctgatcagttcattcttccttggaaggatccggatgatattaccggtcttctcttctgcatctaagatctcatattctaccagatctccgaccagtggtttaatcttctccttacggaaaattccttttgctttacattcataaatgacagattctactacgtcataaacgtagtagaatcctgcaatcccttttataattcttccctgcataaaacagtccttttaatttcctgtattgttgccgttatttgagttgttaccggaattattgctgcccgaattgttactgtcggatccactgcttgcctgtgagccattgcttacatacagtgtgatcgcagttcctacatctaccgatgtaccttctcccggatcaacttttacaacttttccagatggttctgcactgtcaatatcaacttctgtataagtcagatttctggcattcagtgctgaaattgcatctccaagtgtctttcctgtcagagttggtaccttcacctgatctgcaggctttggtcctttgctgacaacataactcacacttgttccttcagccaccttcgttccggcatctgtgctctgacggataatcataccttctgcataatcatctgaatattcttcactgctcgttccgccatcggacagtctgcttgcactcagtgtagataccgcatcatttacatacattcccacaattggcggaactgacaccttatccggctgtttttcacctttactgatatacagtgtgattttagagtcagcagatacctctgttccctctgccggatcagtccttgttgcttttccactttcaacatcactgctgtattcactggtaacagtaatgttcttgctcgtaaagccctgtttgatcagtgctttcttggctgcatcttcattcattccctctacactctggatcatgatcttttccggtcctgaacttattacaaccttgatcaccgtatttttcttgactttctttcctgcttttgtcttctgctcaataatcgtacctgctgccttatctgatgctttctcggattctacttccagcttcagctgcttcttttcgcacatcgtctctgcaacattctgcggctgtccgaccagatttggcacttcaatctcattggaaactgaaatctgactgtctgaacgcttaccgaacacacctgctgctttgccgatcaggaaaatcagcgcaaatgcaacgatcactgcaactgcaaccatgaggatcttcatcatcttgttcatcttcggatctacgccatttttactgttaccgcgtctgcccccgttataattatcctcttcgtcatcctcatcatagtcatcattttcatcatattcttcatcgtcatagccatcatcatactcttcgtcatcataaccatcgccctgacgctttttcatacgtgccatccgctctggcgagatcatcaccgtatctcccatactccggatcggaaccatatctacaaattcgccactcggatcgaccaacgccctcttcagatcctggatcagttctccggcactctggtaacgtctttctgcgctcttctgtgtacacttgagaataatcttctccagcgccggatataaatccggtgcatactcagaaggcggggtaatattctcctgtaaatgcttcattgcaaccgaaacagtagaatcgccatcgaaaggaacccttccggtcaccatctcatacatggtgatacctgcagaatagatatcactcttctcatcacaatagccgccccgtgcctgctccggagatacatagtgtaccgatcccattgcactggtgctgactgtctgcgatgttgtcgcctttgcaataccaaaatccgtaacctttacctttccttctttggaaatgataatattctgcggtttgatatctctgtgtatgatgtgatgattgtgagctgcctcaataccggtacacatctgaattgcaatactgatcgcttccttggaagaaagctttccttttttatgcacatattctttcagagtgattccttctaccagctccatgaccatataatagagtcctcgatcctcccctacatcatatacattgacaatattcgggttcagaagccctgctgctgcctgtgcttctgaccggaatttctttacaaagttttcatcttccctgtattcttttttcaggactttcactgcgacatatctgttcagcatacagtccttcgccttatatacatccgccattccaccggctccgatcttgctcagaacctgataacggccacttaaataaatcccgtcttttaccatatactcacctcatcagaaaacggttctgcaagaacaacactgatattgtcattgcccccgttctcattcgcccggtcaatcagattctgaccggcttctacgatatctcttgcccctttaactatcgcaaaaatttcttcatcctctatcatattactgagtccatcggaacacatcaggatgatatctccctttttgaggctgaattcataaaaatccacctctacatcctcttttactccaattgctctggtaatgatattcttatccggatgatgtcttgcctcttcctcattgattcctcccagacgaaccatctcttctaccagggaatggtctctggaaagctgcctgatatccttattcagaagatacagacggctgtcacctacatttataaaataaagtgtatgatcgatcacagttgccgcaaccagagtggttcccatcccctccagattaatgtcttcatctgctttctcgatcagcttgtggttcgctgtctgagccgcatcttttaaaatctcttccggcccatcctttaatgtatgcttcagttcttctttcagaacttccaccgtatattttgacgcaaaatcgcctgccttgtgtccacccattccatcggctactaccagaagattcggcagcgtacctaatgactcatctgtggcaaacacgtaatcctggttcatttcacgttttcttccaacatctgtcatagaaaatattttcatattttatactccttgcatcgtcttgcgccgtaactgtccacaggctccgtctatatctgagcccatttctcttcttatagtaacatttatcccgtttttttcaagtttatttttgaaattctcggcactttttttgtccggtttttcgtagtttctctccttgatcgggttcaccggaatcaggtttaaatggcagtttctgtcttttaagattcccattagctcttttgcatcctccggtgtatcgtttacgccgtgaaccaggctgtactcaaaagtgatcctccgtccggttttttcaaaataataatcacacgcttccagaacctcatgaagctcgtatttatttgccaccggcatcagcgatcttctcttttcctggttagaaccgtgcagggaaagtgccagcgtgatctgcagcttttcttctgcaagtctccggatgttcggtacaattccacaggtagacgccgtgatatttctctggctgatattgagcccgtgctcatcactgaccatgtgaatgaatttcagaaaattgtcataattatccagcggttctccggttcccatgatcacaatattagaaactctctcgccagtgatcttctggatctggtaaacctgtcttaacatctctgacggtgtcaggtttcgttccagcccgtccagtgttgatgcacagaaacggcatcccatccggcagccaacctgcgaggatatgcataccgaattgccatgtttatatttcatcagaacactttctaccatattcccgtctttcagacaaaacaggaatttattggtcccgtcaatctttgaaatctgtcttttttccatttcgactcttcgtatttcgtatgctgcttccagtttctggcgtaaagtttttggaagattggtcatttcttcaaaatcatccaccagcttttcatggatccaggaataaatctgtcgactgcggaatcctttttctccaatcgccagcatttcttcctgcaactcttcaaatgaatacgaagcgatatcttttttttccattatctgcccctccggataaatttagcaatatagaaaccatcggttatatcagacgggaaaatctgtttctcccattccaggtcaaattccggatgtttttcggcaaaccatccggcgttttcctcgttctctgtcctgctgatcgtacaggtgctgtacatcagtgttccctccggcttcacatatcggcaaaccgcatccaggatctctctctgaagtgctgcaacttcagtctccgtctccgggttcatcttatacttcagatcggtcttcttcgcaagaacaccaaggccggaacacggaagatccgcgatcagaacatctgctttttcctcagagtccgcatcaaagcaggttgcatcctgctgcactgcacggatattttcaaatcccatccgtgaaatattttcccgaatcagctctaccttcatctctgtcagatcccttgcctctaccatacctgtcccattcaggatctgtgccgcatggagcgcttttcctcccggtgccgcgcacacatccagtatgtaatctccttctttgattcctgcctgttccgctaccatgatcgaagctgcatcctgtacctggaattttccttcccggaacgccgggattgctgccagataatcatagcctgagatcagaagcgcagacgcaagaagcggatgttcttttacctgaatgccttctcctgtcagctctctgatcagctcttctttggtggttgcatttccattgatccggattgttgttgcacgttctttataaaaaccttccaggatgtatttcgtcttctcttctccataatctctcacccacatacggatgatccattgtggcatggaatactttattgagagaaattcttctgtattctccggatacgcaatcttatcaatgtttcgcgcgatatttctaagtaccccatttacaaatccccgcaggttcttaaagcctttccggatagcaaggttgactgcttcattgcatgctgccgaatccggaacctgatccatgtatttgatctgatagaccgcacagcgcaggatattgcggatcaccggtttcattttttctgtctttacttttgaaaactggttgataatatagtccagttctatcctccgctctgttgtcccttctgcaagcctggtcagaaatgcacggtcctgcttggacagatactgatatttttccagcacctgtctgagcacgatatgacttttctctccacgctcgatttccagcaggatcatcagtgcaagttctcttgtacctactccctggttattcgtcgtcatttcttcttcctcctgtcaagatcagtattcttaaaagctgcagaagtgcagatgctgcactcgccacataggtaagcgctgccgctgtaagaacacttcttgcctcacgtacttctgattcatatagcatgcctgaatttttcaggattttaagtgctcttcccgatgcattaaactctaccggaagcgtgatgatctggaacagcactgccaatgaaaacatcaggatcccaagattgataaacaatgtagacatttctcctctgataaataatcccattatgatcagcggccatgaaatcccggatccaaaattcgccaccggaacaagtgctccgcgtattgtcagcggtacataatgccttgcatgctggatcgcgtgtccacattcatgtgctgcaactccaagtgccgcaaccgatgtcgaaccgtaggtggaatctgaaagccgcagtacatggttcgccggatcgtaatgatcggtcagttttccacttactctcatcacctgtacatcataaatcccttccatcctgaggatctgctccgcagccatcgcaccggtgatcccggcgtggttgcgaacctgatcgtacctggcgtaagtggaattcactttggcggatgcaagggcgcagatgatgacgccgatgatgacaaggaaataagttggatcaaaataatatgggtagtacatgtttgcctccttgttgaataagggtccgcccggaagcgaaatatattcgcacgcaggcccgctcgcgcttaatccggaaacgcagcggtactaagcgcgaccttcgcttgcgctcggtcttgctaagtgccggcgttttcgatgacctgcttagcgaatatatttcgcttccgggctacatttttcaatgggtgtcggctgtttgtcctatcgtgcggtgcacgatgggacaaatgcgccaaagggcgcgaaaaacgcttggcgttttttggcgccaattagatttgtttggcagaccaaaaactatttattaaatttgcaaaactcaaatttttaggattgtaattctaacctaatttctctcctgtttctatgtggtatccgcgtaggaaggcatcggcttccatgcgttttttgcctggaatctggagggacttgatggctagtctgccttcaccggtctggactttgaagccgtgttttgtgacttctgtgatcgttccgggctcatgagtatctatggtttctacaacatcctctacttctgcttcccagattttcatcgttttgccttcccactgggtgtaggcacttggccatggatttaagccgcggatcagtcgttcgatttctactgctgttttcgtccagtcgatctcaccggattttttgttgagcatttttgcgtattcggtggtgctttcgccctgtttttgtggagtaatggttcctttttccaattctgcaagggtatggacgcagagtgcggctccttttgcggaaagtttatcgaaaaggcttcctcctgtttcttttttatctaatgtgatttctactttttccagcatatcacccgtgtcaagtccttcatccatctgcatcgttgtgacaccggatactttttctccattgatgaccgcccattggatcggtgcagcaccgcggtatttcggcagaagggatgcatggacattgatacatccgtacggtgtcatttccagaatctcttttggaaggatctgtccaaatgccacgactacgcagacatctgcctgatattttttcaattcttcgatacattcagattcccggatcttctttggctgatagaccggaatattatgtgcaagtgcacattcttttaccggagtgaactgcatttctttgcctctgccctttggcttgtccggctgtgtgacagcgagcactacttcatgtcctgcttctaccagtgcttccagtgttccgactgagaaatcaggagttcccataaatattatcttcatcttatcttcctcccgcttccagcctaggcttcttcgtattctgtgctgtgaagttcgccttctactttttctacataaagatgaccgtccagatgctccagttcgtgacagattgctcttgccatcagtccttcgccttcgatctcgtattctttcatatcttcatcaagtgctactgcttttacataattcggacgggtaacaataccggatttacctggtacactaaggcatccttcttccccggtctgttctccgctgctctctacgatgcgtgggttgatcatgacaaccggaccttctccgatatcgataacaacgattcttttgagaattccaacctgtggtgcagcaagacctacccccattgcctcgtacatggtctctaacatatcatcgatcagttctgttgttcttggtgtcatctttgttacttccttacacacctttgtcagtacttcatcgcctatttctctgatttttctaattgccatttgttcttcctcctgccttttcttttaaaatccactcatcggatcaaaatcaaactgaatccgcatctttgcaaatccccggttcaattcaatatattgttccattttatctttcatttctatcaggatctcataggattcctgcttcagatacaacactttccggtacacatccttgacctttccgactgccggagctgccggaccgatcacctgtaccttgcggttcttcgtgatccgcattgcatataatttgagatagtgcattcctttttccagaagtgcttcatcctcacaggctaccagtaccgccatcagatgctctgccggcggataccccatcagttccctgtaattcatctcttctgtataaaatgcctgataatcctgacgtgctgccgtctggatactataatgctccgggctgtaggtctgaatcacgacctctcctttttttgcccctcttccggcccttcccgcagcctgcgtcaaaagctcgaatgtcctctctgctgaccggaaatcatccgagtataaggacatatccgcagcaagcacgccaaccagggtcacatttggaaaatcatgtccttttacgatcatctgcgttccgacaagaatatctgcctcttcatttgcaaatgcagatagaatcttttcatgtccttctttggatcttgtagtatccagatccatccgaagtacccttgcctgcggaaattccttttttaccagttcttcaatctgctgtgttcctgcgcggaaacctccgatatgaggggagccgcaggacgggcatttttttgcaaccgtttcttcgtagccacagtagtggcacaccattttcccattattgtgcgctgccagtgaaacatcacaatgaggacattttactacatatccgcaggacctgcaagaaaggaatccggcataccctcttcgattcagaaacaaaatgatctgttccttctttttcagacggtcttccatcagctcatggagcctgtcacttaaaatagaacggttccctttttgcagttcttcacgcatatccaccgtgtagacctccgggagttctgcttttgcagtccgcctctttaattccagcaacgtatactctcccagctcgcaccggtaaaatgcttccatggaaggggttgccgatcccagtaccacacttgccccttccaggcttgcgcgttcgattgccgtctcccgcgcatgataccggggaacctgttcacttttataagctgcctcatgttcctcatcgatcacgatcagcccaagactcggaaacggggtaaaaagtgcagatcttggaccgatcatcacatcaatctctccttttttcgcccgcatcatctggtcataccgctctcccgctgaaagtctggaattcatgatggaaacgcgttccccaaatgtcctgtaaaagcgcatcaccgtctggtaagtcaatgcgatctccgggatcagcacgattgcctggcgcttttcctttaccacctgccggatcatttccatatagacctctgtcttgccgcttccggtcacaccgtataaaagataggtctttcggatcccttttttataatcgttttcaaacgtccggattgcactttcctgctcctccgtgtaggtaataaaatgccgctgctgctctttttctttcacaggattacggtaaatcttatgatttttgatttccagaaccccctgctcttcaagcgctctcaccaccgtcagcgtgatattcaacttctggctgatcagagaatattctacctcttcatcatccaaaagtgctgccatcaatcttgcccgcgctttctggttcttgtgaagatattcttccagcttcttttcgcctgcttctctggaaatacatctttttaaaatccgctgttccttctgctgctcggtacgcttgattggaagcaccgttttcaatgcctggatcatcgtacctccataatattctttcatccacgctgcaagtgcaaccagccttgcctcaatcgctacacttgatgtatctgtgcgcagaatatcctttattttttccgcatcataatcacatgtttccgaaaaaccgacaatataccccttcgtttcccggttcccccgtccaaacggcacaatgacgcctgcaccggttcgtaaatctccttccagttcttccggtacacggtactgaaatactttatccagtttttcatgtgtaatatctataataatgtctgcgtacattctgtctgttcctttttctgtctcttttgtgcagcaagcctgacggcttttcgcaccagttcccggtcatccatcggatacctgactcccttaatctcctggtaattttcatgtccctttcccgcaatcagaaggatatccccttgtcttgccatttccaccgcaaagagtactgcctcttcccgatcctggatcatccgataggctccggaagtttctttgatgccttcttcaacatctgccataatcttcgccggctcttcccatctcggattatctgaagtgatgatcgtcagattcgcaagctctcctgccactcttcccatcccgcttcttctgcttccggcacggttgcctccacatccaaacaccagtaaaatacgttctggttcgtaaattctcagcattttaagcacttttgcaagactcatggcattatgcgcgtaatcaatgtaacacaggatattttctcctgcatctacccgttccatcctgcctcttaccaccagatgctttaacacgtctcctgcttcttctctttcaaatccaagacagctcaccgtctgtaaagcagccagtgcattgtacacattaaattttccaggaagggcaagctcatattttctatcatctgcataaaataccgttttaagttctccaccttccatcagaaaactgattttttctgctgtcagtacatgactgtttctaaatcctctttcctgcccttcttcttcccgacaggtaaatccgtatttcgtgcaacattttctctggaacatatagctgcactgtgcatcatccagattccctattccaatcctgcactgttcaaaaagacatgatttgtaatatcggtattccccaagacttgcatgctcgcctggtccgatgtgatcctccccgaaattagtgaataccgcaatttcaaaccagattccatcgatccgatgctgctttattccctgtgaagatacctccatcaccgcatagtggcaacctgcttctaccattttagcaaaatacgactgaatggtaaaggcatccggagtcgtattttgcgaagttaccacttcatttccaagatggtggccgatcgtaccgatcagtccgcatttttggccaatactttccagcatctcccagatcatcactgccaccgtacttttcccctttgtgccggtcacgccaatcactttcaacttatcagcaggacttccaaaccagatcctgctgatcccggcaagagcttcccgtgtatcttttaccagaacgacggcaacattttccggaaacttcagcatccttcccccagataccagtttttctatcagaatgcaggatgccccaaggttgcaggcttcttctatataatcatgtccatctgcccggcttccctgaatgcagacaaacagactgtcttcttctgccttttgggaattacaggtaatcccccggatttccatctcttcttctaattccggcatttggatcaccgcatgctgaatccttttaaacagaaccgaaagcttcataaggctcctctttttggactctttgttttcagaatatgctgtttcccctcaaacgtcacaccggatatgaaaatatataaaatgggtggatttcctgctttcgttttcacgcatcctgtgcgtttgcaggaacacccacccatctctcagtctctattgatgctttttatcatactcggcaagatattctttaacatactgtgtatctgatttgcagtccagatactcacagccatatttctgtcttgtctcatttccttttccggtaatcaggaaaatagtctttccctctgcttcatccatcgctgctttgattgcctctccccgatcctcgatcatggcatacggacagttctgagcttccacatactgtgcgatttctttggaaatctgctctaccggctcatatcccggatcttccgctgtcagataaacctttttcgcatactgaccagctaccgttccaaggtctcttctccggataaatgctttctttccggggcatccgaagatcgatacgatattataatccggatattcatcttttattgaagagaacagcttttcaaaactaagcttgttgtgtgcataatctacaacagcgatcagattcttatctgcacttccataaagctccatacgtccgctggatcttgccctcaaaagtccgctgtgcatatactccttcgggatttcaagaagaatggatgccgcaatgacagccagtgcattttccacattgaaaagtcccggcatcgtcagacggaattcttcatcaaacagctctgtctttaccataaataccgtttcatgtccgtctttctggatctcataaccataaacatccgcttccggattctttgtactgaacgtcagcaccttctcacagacctttgactctttcagaatacggtctgcaaaatctgcatccatgttcacaactccgtaacgtgattttccgaaaattttcagtttagacgaaaaatagtcttcaaaatccggatgctcgatcggactgatatggtcctctgaaatattcagaaaaattcccacatcaaactgcatgttatcgacacgattgtattttaacgcctgtgaagatacttccatctcggcaaatgtaataccactttctacggcatggcgcagatgctcctgcaattctaccgactccggcgtagtaatatgggattctttcttgatcactccgtcataaatatcgattgaagaaaggactgcactttcctttccaccggttgcttccatataatcatccacgattgctttcatatagtaagcggaagtggattttccttttgttccgccgattccggtgatcgtcagtttcttccacggtgcattattgaacttctctgcaagtggaggcatcgccttacggatatcgtctaccagaaaatatggaacatcttctttcgtttcatattttacttcgctgacataagcaatcgcacctttttcgatcgctgcatccagatactcagccttaaatgccgcacctttacaaataaacaatgtcccttccgtcacctctctggaatcatatgtcagatatcctacgtttttttcttcttccccatttgaataaaattctttcatcatacgcaggttctgtaacagatttgcgtactcctgtaatgtgtatttttccatctggtatttatctcccttatattctttccggtattattcccggtactctgcgccggatctgatgatggattctcttaccagaacatccattgcatccatgcagtctgccggtacctgataatattctttgaataccgaaatctctgtgcatgcaagaatgactgcatcacaaccttttgccttcagatcattataagcacggtcaaatttgttcttgtctcccggctttccttttttgatatcatcatagatcagcgacatcacatctttctggcaggcttctcccggaactaccggtgtgattccaaatttttcgcaggctcggtggtaagtctttgcctgcatcgttccatctgttcccatgatcccgatcttcttcacttttggatgagcctctactacatatctgacactctcctctaccatattgatgatcggaacacttgtagatttctggatatcttccaggaaatagtgcgaggtattgcacggaatcgcaatattttctactcccagcatctccagatctcttgcgtcctgtgtgatcgctttcagaaacggaagcttatttcctgtaaggattgcctgtgtcctgtccggcattgtcgcatgacttaaaatgatcatgttgatatgctcctgatcactctccgcctttgtcctcgcgatcactcttgcataataaaaacttgtcgcctccggtcccattccgccgataacacctaattttttcagcatatcattctccctgtttcagcttctcttagctgtaatattttttaaagttaccaaactgtctgagatgattcttcaccatagcaagataacgtcttggtttaaaatcacctctcttaaataccggattgaccatcttcttttccttaagaaggcgtctcatcttctcacggtttgcttcttctttgatatatttgaaagcaactgccttcggtactgtcatccagagatgttcttcttttgcaaattcaagcggcagttcttttccgtaaacatattcttctactacatattttgcaacattgaatccagatcccgtcacataataattacttcgtccctggcgggtgttgatctcgaagaaacggtatttgccatcacgcctgtcatacttgatatcaaagttggagaatcctacatagtgcaaatcttccagcagattcttcaccttcatcatcagctcttcgtttggctctgtgatgataactgcatgatttccaagtccgtgtggtgtgtgttcttccaggagtacatgtcccagacacatcattttaacttttccattccggtcagaataagaagtcagaacacgcatatattcatcatttcccggaatcatatcctggataatcagtttatctgtataacctgccccatagatatcccgaattactttttccagttcttttctgtccttgatcgtgtagatcttattctgggttgcaaacggatgctcccagtaagaaatactgtcagacggctttaaaattaccgggtacgggaaattcatctcaaaatccagtcccatggactgatcgtaaataatcgttcccggataatctaccccatgcttttcgcacaacttgtagaaagtctctttctgctgcagactgttcatcagatcaaaatcgatatatggtgcgataatatttttctcaagctctgccttatgcttactgatcagcgccacataactgtcaccacatccgatgagcataatctttttgtctttatgcttttttgcaaatccattgactgtctgaagaaaataatcgtccgtatcaatcttcggattcggatgatattcgatgatcttacttccgtaactcggtcctgttgcaaactttccaaatatatatgtcttcacctgatactgctcataaaatgcgcgggcaacactgtaagtattgatatctccaccaagcagtaccggaataaattctctgtctttaaattccattgtttaaagaagctcctttctatccccttatatttctatatatcatctcattatactccagggattctttaggtgtcaaggcatggaaacagctctgaaagtttcccgggaaattttcagaactgtttcttttcatatttcttctctttttctctctgctccagaacactgccccgtatcaccgcatccgccccatactttcctcggatctctcccattgccgcactgagctttttcagcttttccatgctcttcttcggcttctcagatttcacctcgaattgcaggtcaaacaggcttaactgctccggttcatcttcatccacaagcttcgctgtgcgaacaccaagcaatctgatcggctcaccgttccacagctcatcgaacagactgcaggccgcctcatagatcacctgatctgcaccagatgctctgccaagctgcttctggtgagatacattctgaaaatcactgtagcgtatttccacactaaccatattggctttctgccctgctttccttagtctctttcccacactttctgccagagaaaatagaaccttttttgcatcctctgccttttccacatcttttggaagtgtggtggaattaccgacaccctttgcagcggtttcctcggattgcacctttgcatcaccgattccattcgcaaattcccacagcgttctcccatgacttttcaaatggaattccagaagcttcggatctgtctgcgcaagctcaccaattgtccggatttccagcttttccagaatcgccacactggacttccctgccataaaaagctcactcaccgggagcggccacattttttccttgacctcttccgggaaaagagtgtggacacggtttggcttttcaaagtctgatgccatttttgccagaagcttgtttgtcgaaattcccacattcacggtaaacccaaacttttcataaacccgggctttgatttcatacgcagcctccaccggcgaagaaaagcgctgtgcgattccggtaaaatccatatagcactcgtccacactgacctgctcgatttccggtgtataggttttcaggaaatccatcagtctccggctatactccctgtacatcctgtgatttggcggatccatgtgaagattcggacacttgcggaacgcatttaccaccggctctcccgtccggatgccgaatttctttgccgaaggagatttcgccaatacgatcccatggcgtgattctctgtcaccgccgatgatcgcggggatcgtgcggatgtccacatcggcaccatttttcagttgttctactgccgtccaactaaggtaggctgaattgacatctatatggaaaatgatgtgtgacattcctgctgtctcctctctgtaaataatcgagcaggctgactcctgctcgatttgtatactttgtacaccatctcgcttaacagccaggtgatgtacattcgacaaatgcagatccttgtgcaagcacaaatctgcacttagctcatcgtatacacaaaaaatacggaatatgatattcattttatcatatcccgcatccattttcattattttatcttttatttatcaagcttaccgccaatttcactccatccacagttaaatacatattgtgcaaattcttccagctgcttctcattatataaacttaaatccatcgttttcagcttggattctactatttttttgttgtatctcagatcggatacatatgaacattccactctctttatcatatcatcaaatatatctctttccatatgttccctcttttctacataatgttaattatgttgtaatataaatcgtccaaactcagtccaactatattctagtctgtattacaaagactgtcaacattaaaaaacgtcacaaaaatacaaaacagtcctttcactttaattatgtaaaacatttattttttcttttttattttcatatttccgagtcaaaatacctatatcgaaaactacaacataattaacattatgtcgtcattctacaagcatttctaacatttccatgctctttttccattccataattccatccgaagcataaatccttgtcacctcgatactgctgtgtcccagaatatccgcaagctgcaacagatttcctgtaaccctgtaaaaaattcttgcaaacatatgtctgaaattatgcggaaatactttttcggtttccacccccgcacttactgcaagctgttttaattctctccatatattcgaccggtctttttcatgacctgatctcgttataaacacatttcccttttgaattctgttttttcttatataatacaacagtctttttctcaactgatccgttaaaataaccggtctgtattttcctttattccacaccttcacgatccctctttgaacactatcaactgaaaaatatcttagctcactgatccggattcctgtccctgcaagcgtctccataatcattacaagctgttcctttccctgctcttttgctttccgcaccagtttgatataatcggatttctgcagttctctttccatcatctttgaattacagccctgtacacggactctgcggagcttccattttccaagcccaacggcaagtaaatactgattcagtgccacaagcatcgaatttacactgcttactgcataatgctgcaccagccactcccggtaagcaagcagaagttccttatctatttcttccgcttctgctgcataggaataaaaagtcgttacatctgtcatatatttcttctttgttgcctccgatgcttcccgctcgatcaaatacttcataaagatttctttttcaaatttcattccgctcataatgtgtcctcctagtttttttttactcacattatttcacagatctgaaattttattaaccaaaaaagcagtaggacaaaaacttttttcattgtcctactgctcatatccgcctatttttcttaattgattttaatttgcatgaatcctatcatagtagtactggaaatctggaagtggaatatccttctttttaatatttttctgaggataaaaaagtaattccacctcttttggtggcatcatctggagttcttcaatcggaatttctcccgcgtgataacgttccataatcaaagataatgttccggatccaatcttataccgatccatgctggagcttcttaatttttatattatattggcttgaatccttttccacgcacttcattcgattccattgtaacaagaaacgctgatgaatctactttctttacagcttcttgaatcgtatacatttctttattgttacatgcacacattaatacttctttttcacgtcctgtataacttccttctgccttaatcaaagttgcccctcgttgtgatagctcatcaatttttgccgcaatttgtggtcccttttctgttacaatcaaagcaagttttccagcatcaacgccatacattagcttatctacgacaaatgatagaatatacgttccaattaatccataaataatcttatcaatgtttccatgcatcagaattccaccaataattacaataataaaatccataacaatgataatttttcctacagaaatatgtggctttgccttgtgtattgccatcaaaacaaaatctgctccacctgtagaggtatctctcatgtaaattaatgcatatccgattcctgagaatacactcatacaaatacaagataacatcatatcaccttggtaaattggaaacaatggaacaacccagtccatcagtatattagaaattaacattgtctttattgatcttaaaaaaaattgttttcccaacaacttgtaacaaattaaaataattggaatattcaaaattgtcgtcattgtaccaattggaattttccaaaaataataaaacacgattgcaatacctgatatacctgctaccggaaatccagatgccactgcaaaattatagactccaatcgcaatgaaacaaccacctacaatatcaagtaaaatatcaattaaaaatgtctttgcctttgatttcaatgtgaattcctccctattacggaatcttatttcttttgcatcacaatacattgatatgtttgcagttttattgaacctgtaaggatttcatcagtaatcaaatttgtataacattcattcaaaaccatcttcacaggatgtctgttaaaattctgaagaaaatatacatcatctttctgttcttttccacttctttttgaaacagtaactccataaggtaatgtttccgtcaaatttgcttccacatttgcttcctcaattacatcgcccaaaaattctttcaaaaattccagatctggttgaacagcaacatagtaagcttttcctttgccatacgcattttctgtaattgctggagtatttacattgtaatcttgcaagtatgttcccaacggctttgcagtttgaagtgtcacaacttctcttaacacaccggctttatatacaccgtctttataggagaaagtatttggaaaatattcattccccacatcaatctcatcaactgataatcctagcaatctctcatgtggtctctctccaataaaacataaatctgtttcatttactactccactccaataagttgttacatatattccacctgcttccacgtatgcttctactttatgaatatactcttttttatgcaagtacaaggtcggagcaaccacaagctgataatctaacaactctcgatccatggaaattatatcaacttcaattcctttttcccaaaaaacccgataatattttaaaagttcttccgtataatcaaattttctcgatattgcttgtgcgtcagaaagagcccaccaattttcccaatccataataatagctaccttcgccctattacatgtacttagtatttgactgcttagcttttctagatctttgccaatccaagcaacttcttgaaaaactctattcttttctgacgcatcatgaccaacaaccgctccatgaaacttttcactcgatcctctgctttttctccattgaaaataaagaacactattcgaacctaacgcaattgcctgcattgaagataagtaattcatccccggtctttttacattattttcctcatcccaattcacaagtgatggtgttgattccatcatcaaaaatggcttcttctgaaatcctctcatctggttatgcataaaggctgcccacacagcaatcggtacttcatcttcttttgtatgccaactcggataagagtcccaagaaatcacatccaactcctttgcccatttatcataatccaatggtaaaaaatacatcatcatgtttgttgtaactggaagatccgaatatgttttaacagctcgaatctcttctctacaaaagtcctgtaactgttcgctcacaaatcttttccagtccaatttcaaaccgtgtaattcatcctctcccctcggagaaggtgaatgaatctgttcccaatcggtataagtatgactccaaaacgcactccaccatgcatgattcaatgcatccaatgttttgtatttttttttcaaccatttccgaaatgctttttgacattcttcgcaatgacaagaagcatccctaaaatttcctccgtattcgtttgatatatgccaaagaattactcctggatgttttccaaagcgttctgataatttcaaatccaactttctagttttttctctcataacagcagacgtgtaacaaaaattatgcctttttcctggtaaattctgtatcccgttttcatctgtctgcattacttcaggatatttttgagtcatccaatttggcattgcacctgttggtgtagctagatttgtatagatgccattgtcatataaacggttaataatttcttctaaatagtcaaactgatattttccttcttctggctctaaaaatgcccacgaaaatattcctagtgaaacattatttacatgcgctaatttcattaaccggatatcctcttcaagaatatccggtctatctaaccattgttcaggattataatctccaccatgcagaagacctggcatatttatttttttatattccatttctaatccctttctttatagatatcatttattattttacagctccagtaataccttctgcaaaactcttctgtaaaataaagaatactaaggcggtaggcaatgtacatattaagactgccaacataagcattccatagtctgttacatatccctctgtcagatttgctacaaccattggcattgtcatgctctcggattgtgtcatgattactttcggccacatataactattccaagcattcataaatgtaatagtcatagccgctgcatatgttgatttcattgtaggaataaacatctgaaagaagattctaatttccgaaagtccatctaatctggcagcttcaataatatcacgaggaaatgatcttgcactctgccgaaacatcatgattaaaaatggggttgatatcgttggtaaaatgaatcccaacgtactatttaacattttcatttttgcaaccatctgaaacaatgggaccaatatcgtaataaatggaaccatcatcgcaagaagaatcacacccatcacggcatcttttgctttatcatgataaatttcaaatccatatcctgccaaggaacatatcaccatcgaaactattgtaagtaatattgcatatttaaatgaattgaccaatgcagcccatacatcttgatttgccagcagatttttcaagttttctcccaaatgagagccaaacgataatacaccttttgatacatccacacttttgtttgtggatgcacttaccatccagtacaaaggaaatactgaaataaaagtaaccaaaatcaagaatgcatacattcctatatttttcatttttttaatcacgtttatcacccaccctcatttgtataaatgctaatactgcaaccaacagtaatataaagaaggacatcgctgctgcatatccaaaattcggcacatacttaaaacataaattatatatgtaatgtgacatagagatcgaagcattcgcaggacctccatcggtcaagttaattgattcatcaaataactgtaatgttccatttgttgacattattgctgtcaacaagatagttggttttaataatggaacagtaatcttaaaaaatgtctgtattgctgatgctccatcaatttttgcagcttcgtatactgaatattcaatgttttgcaatccagaaaggaaaaataccatattatatcctgtccatctccacaaaagagccaatatgataactatttttgccgcaaatggttgtgtcaaaaaattatatggtttatccaaaattcccaaattcactagaacataatttactaatccatcatttgcaaacaaagaccgaaaaataattgagtacgcaaccaatgaagttgtacacggcaaaaaaatcattgttcggaaaaatcctttaaaccgtaagtcttttttatttagaatacaagctaacaccatcgctactacaagcataatgggcacttgaagaatgaaataaaaaaatgtgttttttattgactgaataaatacatcatcttgaaacattctgatgtaatttgtaaatccagccatctgcatatttctacctttccccgtctgaaaagataaaactaacgctttaatcattggccaaaaactaaacaccgcaatcaaaaatgttgctggtgccaaaaaagcccatcctgttaaattatgctttttttccaacgtcatttttcttggtttgttagacacaaaaactcctcctctctatccataagggagatggttctacattccatccccttgtatgataggaacctttcttactgtcccatattaaaattaacagtatcttccgcttttttaagctctttctttaaatctgcaccatttgtaatatttgttgtcgcaacagagattgcgtctcttgcttcatggaaatatggtcccgtaataatagaaggaacttttgttgaatagtcaactattttttcaaacactgcatcaccagagaaaaattcattcggtactgcatatgcatcagaatctcctgctggtgtccatgtagcaattgctccacaagagagaatattattatataactctgtacttccagcaaatgtagatgcaagaaaatcttctgctaactctacgtttccacaattccctgagattgcccaggaagaacctccaatatttgaatagtttgtggcaccctttacatttgtaagttttggaatatttgtaatagcccattttcctgactgatcctcagctgtctgaattgttcccataatccaacacccattaatcacacctgcaacttcactgttcaacattgagccagtgtattcatcccagttatttacttcctgtaacacacctgaatctttcattttacaatatgtatcaattaccttcttcaaagtgtcattttttgcaatattcgttgttccatcttcattaaacaaagatgctcctgcagactgtaacatcatcgtaagcaaatcacattcgcctgctgtcgttgtcaataatggttttcctgttttttccagtactactttgcctttttcaacccactcatcccaggtaatatctgtaaaatcttctaaagtcattccagcttcttgcaaaatatctgtacgataacaagcaattgctgctccgttgtcaaaaggcactccatagtgttttccatctacaacagaaaaatctgttttaccaggagcaaattctgaaaaatcaattttcttttcagaaatttctttaaatacatctggataagataatacatttttttggaatgcctggtcttgcagcaaaaaaatatctggcaatgtgcttagatctcctgatgtaccagccgtagtaagtctagactgtacatctacatctccaacttcgacaatatcaattttcacatcttgatgatcttcttgataaatttttgcagcttcttccattgcaaaaatattaaatgttttgtcccaacaccatactgtaattgtattatcgtcttttttgtcccctgaacctccgcatgctgcaatacccattgccatcgtagctatcaataaaattgccactattttttttctcattcgttatattctccttctaccatgccccttgataccctattgttaccgcactattctgagctcctgcttccatcgaatcttgaacattcaatccattcaaaatcccatataaaaatccggcaataaaactgtcgcctgcacccattgtatcaacaactttacactctatgattccaaatcgataccaagaatttccatcatacccaatgcttccatttttccccaatgttgcaataatgactttaggtcctttttgttgcattgctttcatgaattcctttaattgttccgtacaattttctttttcttttaagcccatgctatgatatttctgtctaaactcattgcgtgattcctcgtcaaaagagaagaatgcatatgtcacatatggaatcgctttctcaacaattggatttgcaaatttattggcaaaatcaaatgcaactggaatttctttcgaaataagtggaagctcatcttcaatcattccccaaattcctgtaaccgctaaatcatgtttctttataaaggaaatgtcttgttctcttagcttaaagtctgccaaaacaccttcttcatattttccaaacactctatctccatctacaatgtcaacatgtgtaactgcggtttttccatccagcacttgaatatgagaagtatcgactcctttattttgaattgcacttatcatgatttttccgaatgaatcagttccaacagcacctgtataagaactttctccacctaatcgttttatgtatacagcaacattcactgggtttccccctggataagattcattcaatgaatcataataatcaatacaattatctcctattgctgctactcttatctttctgtccattttgccaccttaatagtccagacatctgtaatatcttctgatttccataggatgacaattgactttttccatatgtacatcaattctctgtgttaccgcatgcatcactaaatgtgatatatatcctctgtactctggactaattccttttaattcaaatttcttggtatcaataatattgtattttccacaaatgcgtggcaagaagtttgcaacgcgctcgctcaatgatctctgagaatcttccccaataaatactgtaactggtgtatctttgtcaattatttctaacattccatggaaaaattcagcactgtggatagattttgtacgaatccaatgctgttcttcccaataacacattgcataagaatatgtggcaccatactggttcccagccccaacaaaataatgaattttgtcatccttatgacgatttgcaaattcttctccgaaagcatctgcttccttttcaacttccacaagtgcagttgccaaatactgatccaactccttgtataaatcctcatattctggaaattctcctgcattgtacataaatctatctgctaccatataaaatttcaattgttcattggcaggatatgtaatcacatagtctacaagttttgcaagttctgcagtagcaacatcaataaaaccaatcacccttgctccactcttctgtgctttttttactccatctacgatttcagaagttgttcctgtaacagacgaaataattacaatagttccttctccaacttttttatttccagttgtcaaatactctgctgcgttttcaacaaaaaatgaaagttttgatttttctttcatatgaacctctgcctggaggcaagatgcatatgttccaccgataccgagccaacaaatattcttgtatccttctttacaaattccatcaatcaattcattaatttgatttctcagagcaagcgctccattcacactttcaatctgtttctgttcattaaatttcaacatagtgttttccctttcccttcttttgtattggtgactatttttaaatttaatataccacttttttcatttttttcaatatttcacgcaaaaaatattgaatattgttgtatttttataaatataaatgcatttttttatacacaatgcatatatttcttttattctggtatgaagcacatttcaggtttactataccagtttttatatttattttttatttattcatttcttttttcctttccatttgctttttaagaactgacaacgtataatttgattataatttacaagtaaattataatattaggagttcttatgaaaaaaaatttattaactttagatgttgcattatcaaaagaaatcaaatacatgctaaaggaagaacactatcttccaggtgacaaactgccttcggaacgaaagctggcagagctgtttcatgtacaacgcttaactgttcgtggagccttgaatctgttacttcaagataaaacaattatctcaaaaccacgaagtggttattacgtagcgcctaaacgcattttacaatccattcgtaatttttccttacattcagaggaagatagcgaacaattaacttacgaattatatgatttcaaaaaaatagaagcagataactatcttgcaagcgaaatgttacttcctgaaaaatcgaaaatatacaaaattgtttggctttattcagatggtactcaactaatttgtatcaatacaacttatattcctgaatatatctatccagatctcacccaacaaattgctgcttctgctcctgcaattgatttgattacaaacaattgtcaaataaccttggcaaaatcgaatcaaaaagtcaccttactttacgcagacacaaagactgctcaaattttaaatattcctgttgatagccctttaatgaaatacaaagggctcatgtatgataaacaaggacatcttgcagtcttttttgaaaataatatgctaattgatcgttttggttttatcagggaggtagttttatgagcaatgatgatgtattagccgcacaaataaaatctagtatcattacaaaaattaaaacacaggaatatcttcctggggagttgcttcctagcgaacgggattttgcaacaatgtatagtgtaagtcggtatttgattcatgacatctttgacgaattaattagccaacattacttaattcgcgttcacggaaagggaacttttgtccgcaaacccgaacaaaatcgagttgctttaggagtactaaatgaatcaaaaaatgctagctttacctctttagttcgtaactttggtattgaaatttccaataaatgcttaggcacaggtataatcaaaaacagaaaatactttgcagataaacttggactttctgaagaagatgaaatatacggtattcatcgaattcgtcttggaaacaaggaacctcttgcaattgagtttacctatgttcctcttcattttttttcagatatcgataattacaattttgagcacatatcgctttatgattatatgaaatccaaaaatcatttgcctgtaaaatttaatgagacaatgatgatggtagaagctggcgaaaaacttcaaaagcaccttcatcttccaagtgccacctctatcgtcaactatattgaattcataggatacgatgaaaatagtaatttagttgaatatacagaaagttattcacgccctgataaacttgaagtgcgctttgtcacaaatgatatctaaattcactttaattttaccatttagtatgtgtatgcaccataaacaaaacaagatagaatatacacaaaataatacttttgttaggggcggggaaaattgaccacctaaagccgcttagaattaaccatttttagtcggataggcaagcttttccttgagattttcttcacgcttgtcatcgaatacagcagaagcattgtttagggtgtcttaatttatgagaccattatagtactcaatataacaaaaataaggacagctttttagaacctcattagttcaaaaaactgtccttattttacatcctatcgttttttatcttttatgttttcttttctgtatttgtgcggtgtcattccgtaacgtttcttaaattgctgattattccggggctctctgagccacctgtccggactttgagagccacctgtccggagaatgagagccatatattcggagctggaccagtgatctcgttatttggatcacagatcggcaatgtacagacagccgttgaaggattcagcggaattacaacgggtgttttgtctgagcttggaaagcttccgaagggattcaaaagcgcaacaaaatcggctacaaattttcagaaagattttacgggtagcctgaaagggcttggcggtgcaattacaggaccgtttcaggtactgactccgaaattgtcagctactgtcggaaagatcggcaaggtagtttccggtgtcccaggtaaaatcggaggggcagttggaaagatcggttctgcaatcgcatcaaaaattcctagaattacaagcgcgttttcgctacttggagatactgccggttatctgggagcatggggcggacagattggttctgctttgcagggagttcttggaacagtagccggctttattccgtcatttgtagggttgatgaatttcggtgcagttgcagccgttgtggtagccggtcttggactggtttacagtcagtttggtacacagattgaccagatcctgcttctggcgcagaccaaaggaccggagatcatatctaactttggggcaggaatcacagcagcacttccgggactgatttcatcaggtgcaaccctgatcttgggattgatgaatgcgatcacggcaaatctaccatcgctcatttccgtaggtgcaagcatcatagcaactctggtaagcagcctgggcgcacaacttccgcagttaattccggcagcagtacagatgattctgactctggttgagtcgctgatcagtaatcttccgcagttaataacttccggattacggttaatggaaggcttggcacagggaattgcaaacgcgattccgcaggtggcagcgaaagcaccggttatcatcggcaagctggcatctatgattatcacgaatttgccgaagatcatacagactggtgtgaagattatcacgcagctcgcagtcggactggttcagggaatcccggcgttacttggtaagattccatccatgatcagccagatcaaaaatgcatttaccagtgtaaactggggcagtgttggtatgaatatcatttccggaattgcaagtggtatatccagtgcggtaggaagcctgatcagcgcggcaacatctgcggcaagtagcgcattagatgcaatcaagtcaaaacttggtattcattctccatcgagagtattccgggaccaggttggtaagatgatggctcttggtatgggaatcggatttgagaagaatattccggtcggatccatgaatgccggagtacaaaaagcagtccagagtctgcaaagaagtgtgcagcttacaacatccgttaatccggataaaacggtaggcggaataaagaataatccgatctttaaggatcaaggatttgattacgacagatttgaacgtatccagaggaagattgcaaaagaaaatggcaacaagccggtattcctggatacgaaacggatagacagaccattaccgaaaggagcagtgccacaggtatgattgtgtattatgaaaatatgaacggcgaaaagctgaatcttttgaaagctccttttcgtacaacgaagactgactggttcgatgcggactggtcagagtcttcggacggatatgaaaaaacagtgacgattgatgtgtttggaaagcgggaagaatttcaggcgaatatggagcagctataccggatcattgcggttgatgcagaaaatgatacctacgggaaactgtacgtgaatggtgcatatttaagatgcaaggtattgaagtcggcaaaagaaggatggaagggatatgtgtattcggaagtggagatcaccttccaggctccagagcttgtatgggtagtagaagctacaagacagttttttccgcaattggaagaaacggcagcatccggaatcgactttcagtatgactatccgtttgattttgccggagaaaaaagaggaatcgcagcatgggatgttgctcacatcattccaagcgagtaccggatgatcatttacggaccatgtgtaaatccgaagattctgatcaacgattatccttatgagtttttcgtgacgcttgaaagcagggaatatctgattatagacagccagagaagaacgatccgaagatatttgacgaatggaacggtacaaaatttatttaatcagagagcacagaaacaaactgttttcgagagaataccatccgggcttttaaatattaactggtccggggattatggatttgacctgactttatttttgaacaggagggagccgccgtggtaaaggacataattcttgcagatagtgatggaagagaactgggagcgattttggactcaaatatcacagtggatacgaatggcgagtacgaattttctgtacagattgcaaggtcgaactggtatccggagctgaccttttcaagctatgtctatattacggagacagaatatggaggcattatcggagaggtgctgacagatacaacgctggattatgtggagctgaagggaatcacatggcggggaagactgcagtataaggtgatcgtgccgcctgccggatcggattataaaacagtatccggagaactgaatcaggtaatgaaaacactgatcgagccggagtttgatggattattcagagtttcatcagaagacacgggtatatctgtaaagaattttcaatttgaccggtactgcacattactggaaggtcttaccaaaatgctgaaaagtgttggataccgcctgcagatccggttgatcaaagaacaggatgaaccatgttatattctggttgaagcagttccgattactgattattctgcgcagattgaattgtcacaggacagtcgactgaatttcacgatggatgataaacaaaatggcgtaaatcatctggttgtaactggaaaaggggaaatgcaggagaggaacatattccatctgtatgtgcagaaagatggaagcattggaaagacgcagtattacaaaggactgaatgaaatctcagcagtatacgaaaatacgagcacagaaacagcagagctggagaaaacgtccgcggaacaattgcagaagctgatgaataaaaagacatttcagatggatgttgcaaagcttggaatcgaggttgggattggagatattgtcggtggcagggattacctgactgggatgtatatgtcaaaaccaatcgaaaatatcatttatgagattacgaatgatgtggaatcaattacttataaactggaaggagaagatgaagaatgaaaattgtatctggaagaaccggattaccacatgtgacttcgcagcagttccggcagatgctggaggggattatcgggcaggggagttatattataacaagcggagagaatctgaagccggaacttagcagtaataatctgctgaaaatccgaagtgggatgatggcgcatcacggctgtatatcttgcgtggatattggtacttatgatgaggttacactgacaaatggtagtcagggaatgaaaaggattgatcttattgtaaatcggtataccagaaatgcagagacagaggttgaaaactgcagttggaaggtgatccagggtacaccggttgcaagtaatccggcagtgccggcatacacttcgggaaatttgcagaatggagatcttgtggatgaatgcccggcctttgaagtgcattatgatggaatcaatgttacagaagtgaagagtttgttgagtgtgacggatggactttctggattaagtagcaatttagtaaatataaattccaaaataacaaccacgaatgcgaatttaaccaaaactaacactgttttagaaaacagaaaaccaataatcattgattcaactgcgcaaggaacagtaaattgggataccaagagctttttgaaggctggcgttacatatgcttttatcgttatagtttcctccaatatcagcagtgaaagctataaacaggaaatcgcttgtgcattaaacaatgtaaatatgggaaataacggaaactattacaaattagtttctacttttgcaggaaaatgtagcaaaggcgataagcttcatattacttcgtacaaaaatggaggctcatggactctttttgcgacaagagctgtttttataccagttagctaaaataagccgttgttgcaatcattacgaatgaggcactatctgtaccgctgatatatactccaccattttttatgtatatacgcgcttgtgttccagcaggtccaccattatgcatagctatcggaataagacactcgtatgtgttataaccatttggtgtcattcctgacgggacatttcctagatattgatcgtttgcaaattttccattatctgaaaatcttatcgatccagcaacaaataccacatgacctattttgcgaaattttagcttttctgaaagattatttgcagtcatatatttccaaccagaatcggcagttgccgtttttaaattggtatttgtagttgctaattctgtgctcaaagcagatatttttgcatttgcatttgtcaaattgctacttaattcagtacgccagttgatatactgaaagcaaaaaggagcaatgtatggaagcaaaaataatggatgtattgcgaagaatgcaaccggttttagatgaaatgcaactacgtgagctgaaagaagtgttacagatgacatttaccggatgcagagtaatccaggaaacggacctgcaggttgtagacaggagctgggaagtggatctggaagagtttctgatgagtaaagcactggaaggaaaagcatcaaagacagtgaagcaatatcggtatgaactggttcggttactgacctatatcaataagccagtgaagaacatagattctggagatatttctggattcatgcgggcttataaaatgatccgcaaggtagcaaaccagacgctaaagaacgtccgggcggtgtatagcagcttcttcggatggctgcgagatcgtgaccggattcggagaaatcctatggtgctggtggaatctatcaaagtagaaaagaagatccgaaaaccatatactgatgaagaacgggagcggatgctgcgtaaatgcagcagtcttcgggataaagcgttactagaattcctatatagcacagcagtcagagtatcggagctttcagagattaacagggaagatatccggtatgcgaataaagagctgattgtatatggaaaaggagcgaaagaaaggacggtgtacatcaatgaacgaaccaacatgtatttgaaagaatatctggaaagcagaaaagacaatgatccggcgctatttgtcggaagcaagaaaccgaatagccggctgacgaaaacaggaattgaggatatcatccggcggattggagagaaggcgggtgtagaaaatgcgcatccgcatcgattccggaggacggctctgacaaatgcattgaaccgcggaatgcctctgcaggaggctatgatatttgctggacacgcaaagtcagagacaaccatgcgatattgtacagtgaatcaggaaggtgtacggtatcatcactttaaatatttaagcgcataagtaaataaacttatttatttacactcggcattggtcgggtgtttttgctatgcgcttttatatatgtaactttatcaaccagtaaaaggagggattctgaactaagtagcaatttaacaaaagcaaataacattttaaccaatatggaaagtaatttaatggctataaatacatatcacatgacacttaatacttctaatgttaaaacgcccgattcatggattgagtgtaatagaattggaaatctggtaatgatcaatggatgcaccaaaatcacaaaaaatgttaatgtatatgctggtcttaatattgcaagtggagcacctgtaccatgttgtaataaacaactttatactgtggcaatagcacaagataatacttattccaactgtttccttgaagttagtaaaagcggtgctgttaatcttctggttagatggcaaaaagcatcgtcaggggatatcttttattacgaattctgctatatatgcaaatagtcattattttatccggattgcccggagttcaataccatttacatttctaggttgactgctccaaaaagcaataccgtatgtgccagcaggaactttttcgatacaggtactggttaacattgggtaaaaaccgttaccaaagttcatataaaacgtattttgggttcgcgttgaatttattccagttatccccattataaacgcatcatagctttgacctttggcacagggagttgcttttagtgtaaagatataagtaccggcgggaatggtcacagtggacacgttattcacccaggtttcttttttaggatatgaataattattttttatgccactccagtattcagttcctatgacattcaagctattatttgcttttatcaaatctgcttttatatttgccaaattgctatttagttcagaatccctctaaaaagaagaaaggggcaaacagaaaaatgaaaatcacattcaatgatggtcaggaactgcagatccagcaggtcactgagcagacggatggcgcacttctgatcaagaccatttcagcatccgaggatcagctgaagactttattctctgatccgacaacaactaagagaatgtctgtgagcgaacgggatgcagataccgttgtgtatgaaaattacacgaagcttgatgcaatcgtgaagtacacggccggcattcttggtgtgctgacgtaccgggaaggagaagatccggacagccggatagcagctctggaggcacgacttaaagaagcagaagagaaaaataagaacctgcagtcaagagtcgaaaaagcggaggagaaaaatgaaatgctcgaaggatgcattttggaaatgtctgaaacggtatatcagtaaaacgataattgtattaaccattttatttttattcatattattacaaatttcaggaggaaaagaaatgatggcaatgttatgggcacagcagattatgttaggaaagaaaacttattcacaggtaccgagacttttaaaggacaaggtaaaagaggtcctgattgattccggagcagaagatctggtaacagaagacaagcagtagaggtgaagcgtagatggcagtaaaaacaactcaatatatatttaatggtcagacttacaatctgacctataattcgacctccgggaaatgggaagctacggttacagctccaagtaagtcgagctataatcagccggatcatgttcttggcggaacagtaaaggctacagatgaggccggcaatactaccacggtagatcagagtcatgctactctcggcgcatcacttaaactccgtgtaaaagaaaagacagcaccgactatcacgatcacgtctccgtctgcaggagcttatatcacaaatacgactccgactatcgaattccaggtaaaagatacagactccggagtaaatgcaggaacaatcgcagtcacagttgatggtacagctgtatcgacggtggatataagtgcacatgcacatcaccgacgttaaaagatggatcacatacgatttcggtcaaagcatccgacaacgatggtaatgcagctgcagctaagacagcaacatttacagttgatacagtgcctccgacactgcagatcacagctccatcaaatgaccttataaccaacaagaagacggtaacggtaagtggtaaaacagatgacgtatcatctaagccagttacagtaacggtaaatggagcaactgtaacggtcggaacagacggaacatttactaaggacgtgactcttgctgagggtgcaaacaccatcacaatcgtagctaaagacaaagccggaaagactactacagtcacacgtaaggttactgtcgatacgtcagctccggtgattaagtcagtgactcttactccgaatccagtagactgcggaaagacattcattattgcagtcgagattaccgactaggcggtgcgcctatggtagtaaaggtaagcggtaagatagatggaaaagaagtaatattcgaaagagctgaaggggaccggtggaatgccacggtcccttatgatttagatggaatgtatgtggtggagctgacggcagaaaatgatgcaggcaatattgcatactgcacgaagatgctgttgatcgttgatccagctactctatgcgtaagacttgttccgcttgattatatggtggaagttgttccggaagactataaggttacagttattccggaagattacgctgtagaggcagttccggagcagtatcaagttatcgcagagccagatccgctctttgtggaggtaatttatccgatacacggaaggcggtgttgttgtgaacaaaattagatttatcctgggcgaagacaagcacgttaagctattggtgcgaagtcctaacgatgagccatttacgattctgacagcatcttatgagctggcacgttatacagacatcgtggtgcaaggagaatgtgatatcaatggtcattatctcgattgcaagattgctccgaaagaaaaaggaacacatatattggaagtgacttatacggttgcggattcgatcaggaaagcaaggatagaagttgaggtggtttaatgcttaaaattacagatgtgaaattaagcaaaaatacggttgcgaccggggaaaaatttacgatttctgtacagatccaggaaacggttgattatccgtatgactatccatacgattatccgatatcttataccggagcagcaaagccggtaaattcataaagaaagaatgaggaatatgaaagtggaacaggcaaactatatcaaagcaatttttacggcagtatttgctttcctgtcagcgcttcttggagtgcttgcagtgccggtgatcctgctggtggtatgtaatctgattgattatgctaccggacttatggcaagcaaatacagagcacaggatatcaattcctataaaagtatcagaggaattttcaaaaaggtatctatgtggctgctggtagttgtgggagcgattattgatgaaatgcttctatatgcatcaacttcaattggttggaagtcaccagtcacatttctggtggcatgtgtcgtggcaatgtggctgatctgcaatgagattatcagtattttagaaaatattcaggacatgggagtgaatatcccggcatttatgcagccgcttgtgaaacacatccgatcgcaggtagaagatcaggtgaaagtggataatgattcagagggcgaatagtcgccctctttttgaaaggagaaacattatggcaatgaatggaattgatattgcaagttaccagacagggattgatctcagtgtggtcccgtgcgattttgtgatcgtaaaggcaacagagggaacaggctacgtgaacccagatttcacaagagcttacgcacaggctaagaacgccggaaagtgtctcggtatctaccattatgcgaatggtggagattaccagaaagaagcagattacttccttgatagaatcggaaaacgtgtaggcgaagcaattctctgtcttgactgggaggggaagagcaacccggcatttggtagctcggattttgcatggtgcaagagctggcttgactatgtataccagaaaacaggcgtgcgtccgctcctgtactgttcgcagtctgtagcctataaattcaacaatatcggaaactacggactctggattgcacagtacgcagacatgaacgccacaggctaccaggataagccgtggaatgagggagcttatagttgcgctatccggcagtatagctcttgtggcagactgaacggatggggtggcaatctcgatctggataaattctatggcgacaaggacgcatggaacaaatacgccggaaaaggaaacacaaccagaccggcagaaacaccgaaaccgacagtgaatactccgagcggatccacgctcgatctggttgttggagtcatgcaaggaaaatacggggctggcgacaaccgcaagaacgcccttggaacacggtataacgaagtccagagcttcattgaccatatctattctgtatccgtagatacactggtgaacgaagtgaaagctggtaaatatggtaacggtgacacaagaaaggttgttctcggtagtcgttacacagaagtccagaacaagatcaacgctgcgtctgccagaaaatcaaatgagcagatcgcacaggaagtgcttgcaggtaaatggggcaacggaaatgacagaaagaatcgtctttcagcagccggatatgactacaatacgattcagaatatcgtgaacggcaagtcaggtgcttcatccgcacagtattacaccgtgcagagcggagatacgctttccggtattgcattcaagtatggcacatcctaccagaaaatagtgcagcttaatgggctatccaacccaaatttgatctatgtaggacagaaactccgagtgaaataataaatattgtcttgtactaactagactaccccaaaaccagtaacaagagtcaaattaattccttcatcagcaaaatacccattttcaatcgcaacgtattgcggggcatagaagatagaatgggcgacttcgttcagtgtcacagagacaggagaagaattggtgtcatgactggcttgggaagtgacggtttcagctttaggattcgtagcattatcatcggcaggtgcagagctgcaagctgataaaaggccgacagttatagcagaaacaaaaagtaaggatataaaattttttttcataagtcctcctgggtggtataacattctcatttaagatatgcaaaaaatgtgaaattggtgtttttatctgatagccaatcgctctccgctgaagattttgaaactccagaacaacctgcaactaaaagtcccttattttatcatataatttatccgagtaatatggcagataaataatagcaaaagtataagccatatgtttcgcttcggctaagtcatttgtccttttttcaccataatatttgctcataagtggctgacttccatcacctacgccctgcaatatcaggttgatgatcaccagtgaaatattaggagtcagagcaagtccgaaaggagcgagtcctgccttaaaaattgatttgcatagagaaccgaattcaccagcatttgcacaaatttccagtttcttttttaccacaaaatgcacaagaaccgaaaacggtttgttgattaatttgtcccaagagagtaaactgaaacataagacatttggggtgtgtgtatctgagaaaaactgaaaaaagataaaataatggaggtgcggttatgggattctggatttttatgcttataatggatttactgattccgtttacaatgatcggcttcggaaaaatgtttttgaaaaaagcaccggatcagatcaattatgtgtttggttacagaacatcaatgtcaatgaagaatcaggacacctgggtatttgcacatcattattgcggaaagatctggtatatctgtggacttattcttttggtggtatctttaattgtgttacttctggttatgggaaagtctaatgatgccataggaaatgtcgggggaattctgtgtgtatttcagatgattccactggtgggttcgatcataccgacggagattgcactcagaaaaaattttgataaatatggaaataaaagataaatcaggaggatgccatgaaaatagcagtatttttcccaggaattggttatcattgtgataagccacttttgtactatgcaagaaaactggttcaggaatatggatatgaaaagatagtcatgcaggagtattcctataatggcaaaaatatacgcggcgataaaaagaaaatgcaagaggcatttgagtgcttgtatgcgcaggcagaaaagaagcttgaagaaatcgcatttgacgagtacagtgaagttttatttatttccaaaagcgtaggaaccattattgcatccgcttatgctgagaaatataagataaaatgctgccagattttgtataccccgcttgaacagacttttatgtttgaacatgatgatgcaattgcatttattggaactgcggatccgtggagcgatgtaaaaaaagtaattgcatgttcaaagaatcaggcagttccgatttatgtgtatgaggatgccaatcattcattggaaaaagaaaatattttacaaaacattgatatcctgaaaaacgtaatggaaaagacacagaagtatttgcggtagctattccaggaaagcgaacccatttgcactggaggtgtcgaataaatcccgtgcaatccggataacgtcgtgtgcataggatggaagatatcctccatggcggtgtgccactgggaagaggagttgaataggaaaagcctattttttaccaggaagatcagaaaaaactgatagagtaaaaaaatcaggttgtggaggagaagatgagattaaggaatatcctgattgtcgtaaaagacattgaaaaatcaaagaaattctatcatgatctgtttggtctggatatcattctggacaatgatggaaacgttattctgacagaaggacttgttttacaggacgaaaaagtctggaaggatgttacaggaaaagaagttgtcccggagaataattcctgtgaactttattttgaagagcggaatattgaagcatttactgaaaaattagaaaaactgtatccggaaaccaaatatgtcaccaggctgatgatgtacagctggggacagaaagtgatccgtttttatgatctggatggcaatttgattgaagtcaggacaccgatgcggggataaagagaaaataacatacatcaggaggacaacaaaatggcagcggtacttttacgtgcagcatctctggcgtttgtcatggtttttggaattttattgaaaaagacgggaatcgtcggcaatccggcaagggtactccgaaaggttgaaaaatagaaaatttacgaggtgagagaagatgaagataaaatcagttgcagttttaggtgcgggagcagtaggctcttatgtgatctggggtctttctgaaaaatcagatatccggcttggagtaatcgctgaaggagaaagagcagaacgtttgaaaaagaacggatgtgcgatcaatggcaagacttaccatccggaagtgtggactccggatgaggcacatgacgtggatctgatggtggttgctttgaaatacggttcactggaaggtgctttggagagtatacaaaaagcaacaggcgagcatacggcgatcatgagtctgatgaacggtattgacagcgaagaaatcattggcagaacagtgggaatggagcatgtgttaccggcactgatcaaagtggcttcacataaagaggaagacggttatcattttgatccaccgaccacacttggaatcattttcggagaaccgtccgcgccgttcgacagcgagcgggtgaaagcagtggaagagttatttgcagataccgggattcatttccgctccacagagtatattcaggaagagatctggtgcaagttttgcctgaatgtgtgcagcaatctgccgcaggcgattctgggagcaggcgttggatgttaccgtgacagcgtgcacatgaaagcaatcagtgacggattaaaaagagagctggaagcagtcgcacaggcaaaaggaatcgatatgagcaagaccgaaagctcgtccggacgaggaagtgcggtcccaccgtcagccagatattccaccttgcaggatctggatgccggatgccacacggaaatcgatatgttctccggcgcgcttgttcggatgggaaaagagcttggaatcccgatgccgtataatgaatacacctatcatatgatcaaggcgctggaagagaaaaacgatggtaaatttgattataccgggaaggaagaactgacctggtcaaaatagaaaatatagagcgggtatgttatgcagaaatcagcataaattaaaatgtgcgatttcgggacgagatgtaagatcagattctcgtaaaaagaacaacataaaatgaaaaaaagaaagagagagaaagcatgaacgaattatatgaagcaattgaaaagaaaatcaaatcatccggatatccgagactgatttccggagaggatgtatacgatgatatctgtgatcagattgaaggaaaggaaaatggagaatatattttactttccaaatttgatgatgatgtcgtgtttgaatatcatatcacgattcaggatgatgattttaatcttggaatcctgaccatgaagacaccggaaggcgtatttgaagtagattttgatgaggaatagaagatgaagattaccgtttatcttggtgcaaatgaaggaaatgttttccgaacgtctggaatttctccagaataatttttattcttatggcgaatatgccctggttggaacaaagggctattgctatgaaggaaaagatacgatcgaacattttgaaaagctgcgcagccgggaaatcgagcgcctgcgggtttctttggagatggcgaaaaaagaaggataccagaaatttaccgggatgatttttgtagaaaatgagacaaaggatgttctatgctttttcatgttatagtagtagttaccagcgtaaatataaggaacggtttcggacaaaaagagcgaaaccgttccttatttggttgatagaagtcactcacatttctccggatcaattttcggcggccgataatgatagacttcttcgtaggattccagctcagctctgtttgtgggaccgacagggatcagaccggtgcagtcctgcgcagatgctgcattagacagataatcgtaggaatcgatgatcttctgattggattttttgcgggatgaattatcagaatgtttttcttttttcatggggacctccttatctgatatggcacaggcagaaaaaagtgaaaatcttaaaaactgccggcaggataagataagtatgtgctgataggtagaaagtatgtatgaaaaaaacggtttctgtctcatttgggtttgaaaactatgtgagataggaagaaagccgtctgttaaacgcataagggcaaaaaatacttgcattctgagtttaagaagaccataatagcaaagggattttttttgaaattatttgaaatcaggaatgaagtaagagagaagcagaggaaaaagggagttaaaagaaaatggaacaaaagcatatgttcacaaataaaatgattgcagatcttctgataccggtcgttctggaacagcttctgaactccatcatgggaacagcggacacaatgatggtaagcaatgtgggatctgcggcgatttcagcagtatcgctggtggattcgatcaatgtgctggtgatccaggcgttttctgcgctggcggcaggaggtgcgatcgtctgtgcacagtatatcggacagaagaatgtgaagcgggcaaatgaatccgcaaggcaggtgctgtttattattacggcaatttcggttgtgatcagcctgatctgtcttgttttccaaaagccgatgctgcgtctgatctttggatcagtggaggcggaggtcatgcgtgcgtcggaaatttatttcttctacacggcactgtcctttccgtttatcgcagcttatgattcggcagcatcgattttcagggcacaggataatacgaaaggtccgatgctcatttccatgatatccaatgtgatgaacattgcaggaaatgcaatgctgatctggggatttcatatgggtgttgcaggggcagcacttgcaactctgatttcacgtgttttctgtgcagttgtagttctggcccagctgcgtcaggacaggcagccgatcgtggtgcgtgattatctgaaaatccgtccagacttccggatgatccggagaattctaagtatcggtatcccgtcaggggtagagaacagtatgttccagcttggaaagcttgcgattcagtcctccgtatcaacgctcggcacagtggcaatcgcggcacaggcaatgacgagtattctggaaaatctgaatggaattgcagcaatcggagttggcgttgggttgatgacgattgttggacagtgtattggggctggcagaaaagatgaagcggtttactatatcaaaaagctttgtatgattgcggaagtgattctgatcatcagctgtctgagtgtatttgtactgacaaaaccgatcacgatccttggtggtatggaaaaagaaagtgcggatatgtgtatccatatgacgatgtggatcacgattgtaaagccattggtatggattatggcatttattccgggctatggtatgcgcgcagccggggatgtgaaattttcaatgctcacatcttgcacgacgatgtggctgtgccgtttttgtctcagcgtatttatgatccggatagttggtgtcggagcgatgggcgtgtggatcggaatgttttcagactggacactccgtgggattattttttcgtggagattccacagcagaaagtggctgaagcatcaggtgatttaaaattcttacatagattttacatggcagatcctttggattttacatacctttgttaagattctgttaaaggtaaggaatttggaaaggaagatgtaaaatgagaaagctgtgggatttctggaagaataaaaaatatggaaaaaagagtatgacaggatggtttctgctgacgaatgcattattgtgtggggttataggtgcagcactttggggagttgtcagtctggtggtgttaaaaggaatatcctggctgatcatatttgcaggatatgcgattgttttcccgggattcctcggaggtgtactttttgcaatgaatgcggaaacaacgatggatgaattagagataaaataaacagacaaagaagcggaaatatcagaaatggtatttccgcttttttcgatacaaatgatgaggattgcgagagtgcaaagacaaatttacaatttttacagattgtatagaaagaaaatacggaaaagactggttattatagagctgatttggtaaaataaagacaataataagaagcaggtgatgaaatatggacagtcagaagaaagatccgctctataagagttttggatacgcatttgaaggaattggtacctgtatcaaaaaagagcggaatatgaagattcactgtgcggcagcggtgttggtagtgattgccggagtgatattgaagatctcattgctggaatggtgcatctgcctgacgctttttgggcttatcatggcgctggagctggtcaataccgcagtagaagcggtggtcgatctggtgacggaagagcggaagccacttgcaaagattgcaaaagatacagcagcaggtgcggttctgattgcagcaattatggcagcgatcgccgggattattatttttctaccaaaggggcttacattccttggactttaaagcagattgaaattgtgaaaggagatagacgttatgggaagcttaggagatggagttaagaaagtattacttgcagggattggtacagtagcagtaactgcagaaaagtcaaaagaagttctggataagatggcagaacgtggagaagcagctgtagaacagggaaaagttctgaatcaggaacttcgccacaatatcaagaagaccgtaaaagaaaatgttaatgtttctgtcaggacatcttcaccggaagaactggatgagctgcttgacaagatgacaccggagcagattgaacagctcaaagaaagaatttatgaacgtgaagcagcagtttcagaagaagaaacaaaagaagtagaggaagttgtagaacagacaggagagacggctgaaactgttgaaacagagacggaagaggaagcagcaaaagaagtcgaagcaattgaatctggcaacgaggacatgaatgagtaacaaaaaccagccaaaagagtcaaataaatacggttccagactgcgggagatgacagcagtcctcagaaaacatgggattaccggtggacttaccccggaaaagctccggctgatcctggaggatctggggccgacttatattaagcttggtcagatcatgtcactgcattccgacattcttccgaaaagctattgtgaagaactgatgcggcttcattccgaggtgacaccgatgccatttgaacaggtagcagaagtgatccgcaagtcctacggttatgagtggaacgaagtgttccagagcattgatgtgcatccactgggatcggcatcgatcgcacaggtccaccgggcggttctgaagactggggaagatgttgtcgtcaaagttcagaggcagggcatctataaggtaatgtccagagatatcagtctgctccacaaagcggcaaagctggtcccgccaggtacgatcaaggacatggtggatattaacatggttctggacgagctctggactgtcacccagcaggagatgaatttccttctggaggcagccagtatggaagaatttgcccagcgcaatcaggatgtggcttttgttacaacgcctcggctctatcgcgaatatacgaccaaccatgtgctagtgatggaatatattgatggatttgcaatcaacgataaagaaaatctgctggcaaatggctatgatctgaatgagattggaacaaagcttgtagataattacattcgccaggttatggaggacggtttttttcatgctgatccgcatccaggcaatgtgcgtatccgtgatggaaagattgtctggatcgatatgggaatgatgggaagacttaccgagcgtgaccgggaacagatcagcaatgcagtcaaaggtgtggcagagaatgacatcggtctgatccaggaagcggtgatggcacttggcgagttccgtggaaagccggatcagagcaagctgtatgaagatatcaataatctgatggcaaaatatggaacgattgatatgggtgatatcgatattgcggaagttatgcaggatctgatggaagtgatgaaggaaaataaaatttctatgcctcatggacttactatgcttgcaagaggactcgccaatatggaaggtgtgcttgccgagatcagtccgcagatcaacatggttgagattgcggcggcacggatgaaggagagctttctgacgaaggaacagtggaaaaaagagataaagaatgatgcaaaaagactgtatcgttctcttcacaaggcaatggatattccttcccttgcagcagacatcctgcagggtcacatgaaaggacagaccagagtcaatctggatcttcatacttcggatgagctttccgggttgctcaggaggttggtgcggaatattgtaatggggctgtgggtgatggcacttctgatcagttccagcattatctgtacaaccaatatgcagccaaggttgtgggggattccggcaatcggtgcgtttggatatctgatggcatttgctattgtaatgtatgtttttatcaaacatatcttttcaaaaaaataaataaacagggggaaaagagatgcggaaggagttttatacagggcatctttttgatgtatatcgttattttggagcgcataaagagggtgaaaattttattttccgtgtgtttgcgccatcggcaaaaggagtgtgcgtatttggagaattcagtaactggacagagatcccgatgtatcaggaggaacagagcggtgtatatgtgtcagagccgattccggcgaagactggtcagctgtataagtactgcatttacacagcaaatggcggaagggtagagcactgtgatccatatggcttccagatggaattaaggccaggagattgctcaatcttaacggatctttatagttataaatttaaggatgaaaaatggatgaagaaccggacagtcggatttgacagtccggtcaatatctatgagatccatgcaggatcctggagaaaaaaaggagaagggcagaccgactggtatacttatattgagcttgcaaagcttctgattccttatgtaaaaaagaatcattatactcatattgagatgatgccgctttccgagcatcctttcgacggatcctggggatatcagaataccggattttttgcgccgaccgcacgttatggaacaccggatgagctgaaaaaatttgtggatgagtgtcaccaggcaggaattggtgtgatcatggattttgttccggtacattttgcagtcgattattatggcttgaaagaatttgacggaacctgtctgtatgaatatccaaatgcggcagtaggtgaaagcgaatggggaagctgtaatttcatgcattccagaggggaagtacgatgtttcttacagtcggcagcaaattactggctgagtgagttccattttgacggaatccgtatggatgcagtcagccgtctgatctactggcagggtgacgaggccagaggtgttaacggaacgacactggattttctgaaggtgatgaaccagggactaaagtcccttcatccgacagccatgctgatcgcagaagattccaccaattttccaggtgttaccaaaccggttgaccagggaggagttggttttgattacaagtgggatcttggcttcatgcacgatacactggaatatttccagagtgcaccagaatacagaagcagagattatcataagctgacattctcgatgatgtattattataatgagcgttttttgctggaatactgtcatgacgaagtggtacatggaaaggcaacgattctccagaagatgaacggagaatatgaggataagttcccgcaggcaagagctatgtatctgtatatgatggcgcatcctggtaagaagctgaatttcatgggaaatgaattcggtcagcttcgcgagtgggatgaaagccgcgagcaggactgggatatcctaaaatatccgctccatgatgcatttcaccgttatatgatcgaactgaaccgcatcggtcaggaaaatgatgcattctggcatgattatgatccggagaatttcaaatggctggactgccatcaggaagaacgctgtatctatgcgatcaaaagaaaaggaaaaaataagaactttatcgcgatattcaacttctcagacgaagaacaggaagattacgaactggataccgaagaagaaggaaaactcagtgtgatactggatacggactgggatgaatatggaggaaatacaaaaaagaaaaagacattgccggcaaaagcaaaaaaagggacgcatgtgacgctggacctgccgccgttttcggggattttgctgatgagttaggtgatgggaaagggacgcccggggcagaacgatatttctgctttcgggcgcgctttcgctccgcaaaaaacgcagcggtactaagttcggtgataccgcaagcgttattccctcactaagtgccggcgttttttgagggcccgccagcagaattatcgttctgccccgggctgtgctatgacaccagaaccgcatcggcgaaggggggaagacggcaccatactaagcgcacaaaaaactaataccaggggggacggcatccgctgcgcatcgcctggatgtggtgtctgacgggaagtggtggcaatggatttacagaagtaccggaggtatattgataaggtataaagtttacgttcctgtgcaacctatcccactgaaattaaaatagtattttcccagtgcggcagcgaagcgcctccgcacaacttgtactggagcgacaaacgcaagcacccatgcattcggaatgaaccccatcggaaacgtcggtacttagtgagaggatgtcgtcagacatcatcgaacttagtatccgctacgtttgcggactaagcgcgagcgggggtgaatacgaatccatgggtgcgtaactttgtcaaccacctacaacttacaaacctccctgtcgtaagtcatcagcccgtttatttcatcttcgatgtcggagagttgtgtatatactgctccgcacaatccctgttctttgagggggtcgatttcttcagacataagtttatgataggctgcctggaattcttcctgtgaagagcagattttatatccgtatgtcttgccggagcaggtatgtcctttgacctggcaggtgtagcctccgtattcggagatgacgaaagcgcggtcagatggagttacgaactgctttgcaaagtagttatgttcacttttgaaatctccctgccgtctgtcaaaccagccactggcggaatcgatgagccgggtgtcatccagttcgcggaataaggcagtgagcttttttgaatcaaactgtccccagccttcattgaagattacccaggtgctgatgcatgggaatgcttttagagcagtgacagtatctttgcattcacggatgaattcttctctgccatgtacatttttcctgccgaagagaggatgaatccggtcgctggtgtgaagcttgaattttggaaagagtgcaggcagccaggtcatgaacggagcatagtaggtgccaccgtttaccatgtcctgccagacgatcattccaaggcggtcgcaatgataataccatcttgcagtctcgacttttacatgcttacggatcatgttgaagccgagatttttcatggtctggatatcatagatcagcgcttcatcagatggtgcagtgtaaagcccgtccggccagtatccctgatccaggactccattcagaaaaagtggttcatggttcagacagaagcggggaagtccttttttatccggttcgatggtaaaggtacgcattgcaaaatagccggtgactttatcttcgcctgcctgtatctcaattgtataaagataaggatcatcaggattccagggatgcatattgttgacgtcacagtagcaggagtaacagcaaagagagtcagactgattggtgcagatccctttggaaatcaggcgaccgtccatgtctctgacgtgacagacaaccgcttcggcatcgctgcatccggaaatcggatgatttaaaagaagggatacgtgtaccgtctctttttcatataaaggggtgagttccagttttttgacatagacagccggaacccattccatccatactgtctgccagattccactctgggcggtgtagaacattccgccacgctttaatttctgttttccaacactgtgataagaagtgtcggaacggtcttcaatgtgtacagtcagagtgttgcaaccctcctgcagagcatctgtgatatcagcagaaaatggaagatatccgccgatatgtgagacaactacttttccatttaccagaactttcgcatactgatcgactgcaccaaaatgcaagatgcaccgggatccgtcggaaggaaggcacttgaccgacagcaggcgctcacagagcattttttcgtgcggctttaactggaaaccggcaccggaaagaggggcttccggagaaaaaggaacgagaagagttccttctttggttatggtatttttttctgaaagaactgtgtaattccattctccattcaggttgatatattgatcgcggatcatttgcggacgtggatattcttccagtatgtgctgcggatcaagagcttttccccaacgggtagtcagtgtctgatgggaagcttttctggaaaagatccgtacacttgcaagtgctgctaaaagattcataaaaaaacctctttcgttaaatattcttatagtctattgtatcatgtgacaacaaaaacaccgcacattttatagaaattttagaaatgaaaacagtggggaaaaacggattgtaaaaaagaaagaatcagtttatcataagaatataagaaaagatgagctgtgagaacacagacaaagagcaggcaggaggaaagaccgatgaaaatagttttagatacacatgcacataccattgtcagcggacatgcatacaatacgatacgtgagatggcacagatggcgaaagagaaaggactggaggcatttgcactgactgaacatgcaccgcagatgccgggaacctgtcatgagttctatttccagaatctgcatatcgtaccgcgtgaaatgtacggcgtgagactgttcatgggtgtggaactgaatattatgaatgaaaagggagaggttgaccttccggagagcacactttgtcagatggatattgcaattgcaagtattcatggaccttgttataaaggcgagcggacggaagaggcaatcacggcggcataccttgcggcaatggagaatccgctgattcacattattggacatccggatgacggaagatatccggtggattatgaacagctggccaaaaaagcaaaagagacaggaaccgttctggaggtaaataacggttcgttaagacctggcggattccgcgtggataccaggaaaaatgatttaaaaatgctggaatactgtaagaaatacgaagttccggttacgatgggaagcgacgcacatatggatgtagatcttgcagattacagttatgcgcttccggtgatcgaggagagttattttccggaagaactgatcgttaatacttctgcagagcttctgaaatcatgtattcagtataaacggaatatgtggaaacagaaaaaagtgaattgttaatacgtcatttacgttaaaaaagcctggatgaaagatagagaaaagacttgatatctagtttttaatactatataatatctatattgaggtgaaaaagaatgacgataaatacggaagatttattaaacagtatcctggaaagtgtcggcagaattgattatattcatccggtagatattccgaatatagatttatatatggatcaggtaacaacttttatggaggaacagctcagttcgacgaagcgttatgaggatgataagatcctgacgaaaacgatgatcaataattatgcgaaaaacaatctgcttccgcctccgaacaagaaaaagtattccaaagagcaccttctggttttaatttttgtctattattttaaaaacctgctctcaatcaaagatattgagattttgttaaagccactgacagacaaatattttgctgtggattcggaatttgacatggaaagtatctatgaagaagtctgtaagatggaaaaaagcaggatcggagagttgcaggatagtattcgtaaggcgtatgagactgctgagcattcttttgtatgtgtggatgatgaagaaagagaacagcttcagaagtttgcctttatctgtaatctcagttttgatgtgtatgtgaaaaagcaactgattgaaaaaatggtggacgaacttccaaagccggataagaaaaaataaaagcgttagcttttttaagaagaataaaaaaaggaacggatttcagattttgaaattcgttcctttttgctattatgtgtttggcaatagctgttactaccaactcctgccggtgtctgtaaaattaagattcggattcttcagcccctgcctgaagtctctcaaataccatatcgtatccatcattaccataattaagagagcggtttacgcggctgattgttgctgtggaagcaccagtcttttctgcaatctccaggtatgttttctgatcacgtagcatcttagctacttcaaaacgctgtgaaagcgataaaagctcattgatcgtgcagacatcttcaaagaatgtgtagcattcttctctgcttttcagactgagaacggcatcaaataaagaatcgaccgcttctgttctgatttttctactcattatattatccctccatgacaaataatcaataagagtgtgacataaactgccccactcattcatacaatgacatattagcacattaaaattttaaagtccagatattttgcaaaattttacagataagaaaaaaggagctagatttttctatttttacgacgaaaaatagggacgagagattctttgacaccccactttttttataatataatgatgcaatagagtctcgagagaggagaagaaagaggaacaaaaatatgagtatttatgatacattaaatgacagacagcaggaggccgttttctatacagagggcccgcttctgatccttgccggagcaggatccggtaagacacgtgtccttacacaccggattgcctggctgatcgatcagataggtgtgaacccatggaatatcctggcgatcacatttacgaacaaggcagccggggagatgcgtgagagagtggatcagattgttggattcggttcggagagcatctgggtgagcaccttccattcaatgtgtgtgcggatcctgcgcagatatattgaccggcttgggtatgatacaaattttacgatttatgatgcagatgatcagaagacactgatcaaggatgtgtgtaaatatttgcagattgatacgaaaatgtttaaggaacggtcgcttcttagtgcgatttcttctgcaaaagatgagcttgtcacaccggaagagatgacacttcgtgcggaaggggattgggcgaaaaagaagattgcacaggtttataccgagtatgaaaagcagctgaaagctaacaatgcactcgattttgacgatctgcttttaaagacggtacagcttcttcagacacagccggatgttctggaatattatcaggaaagattccgttatatcatggtggatgagtatcaggatacgaatactgtacagtttaagctggtaagccttcttgccggtaagtatcagaatctgtgtgtagttggtgatgacgaccagtcgatctacaaattcaggggtgcgaatatcatgaatatcctgaattttgaaaaagaatatccgaatgcgaaagtgatcaagctggaacagaattaccgttccacatccacaatcctgaacgccgcaaatgaagtgatccgtcacaatacaggacgaaaagagaagtcgctctggaccgagaatggtgagggtgagaagattcagttccgtcagtttgattctgcttacgatgaggcggattatattgtcagtgatatcaaagacaaggtgaacagtggaaaaagagaatataaggatttcgctattttatacagaaccaatgcgcagtcacgtatattcgaggaaaagatggtggtatccaatgttccgtataagatcgttggtggagtaaacttctatgcaagacgcgaaataaaggatctgctggcatatttaaaaacagtagataatggaaaagatgatctggcagtacggaggatcatcaatgtaccgaagaggggaatcggactgacaactatcggaagggtgcaggattatgcaacggaacgggagatcagtttctatgaagcaatcctggctgcaggatcggttccgggaatcggacgtgcgcttggtaaaatcgaatcctttgcagccctgattgagcattttaaagccgaaggcgaacgcatgagtgtagcggaattgatggatgagattatcgatgcaactggatatgtagaagaactgcaggcagattctgatgaagaagcagaaagccgtctggaaaatattgaagagctccggaataaaattgttgcatacgaggagtcctgtgaagcagaagatgaaaaatcgacactttccggttttttagagcaagtggcattggttgcagatatcgacagtcttgatgaggagacggactatgtggtgctgatgactttacatagtgcgaaaggcctggaatttccacacgtctatctcgccggtctggaagatgggattttcccaagctatatgacgatcacggcagatgatccggcagaattggaagaagagagaagactctgctatgtgggaattacccgtgcaaaggagaatctgacgctgacctgtgcaagacgacggatggtacacggtgagacacagtataataagatgtccagattcttaaaagagattccgctgagtctgctttctaccggtgccctgttcaaaaaagagcagacagaggaggaaccaaaggtatctgcttaccgtcaggcaaagcaggcatttgcgacaaaagcgttcgcagcgacaaagcctgcacagcagtttactgtgaccaagggaaaaggtccgggatatgatgtgggggacagagtgcgtcatattaagtttggggaaggtctggtgacacagattacagaaggcggacgagactatgaagtgactgtggactttgatacggcgggcacgaagaagatgtttgccatgtttgcaaaactgcagaaaattgactaaaattgcactatgtgcctaagaaacacattctttttcggaaaatctgtgcaatatggtggaaattatgcatggatttgtggtatactagctataaacaatgagtgagccgaagcagagagtgacggcagaaagggcgtgtatggagatgaacagaatcgaagaattacttgcaacaacgaaactcaacgatatgatgcataagaaagatgatgatcagaagacaactgttctctggattcttgcaattatcggtgcggtagcagcagttgcagcaattgcatatgcagtatattgtttctttactccggattatctggaagactttgaagaagattttgacgatgatttcgacaatgatttcttcagtgatgaagatgaagtacagtaatattaagaaagcagcgaaggcaggaattgtcaaagattcctgccttttctatgtgagggtatatagatagatgaaaaaaggacagatattagaaggatatatagaaagggtagatttcccgaataaaggatttgccgtggtagaggacgaagaaaaaaaagtgattgtgaagaataccattccggaacaaaaggtgcgtttcgcggtgaataagatacgaaaaggtcaggcagagggacggcttctggaaattctggagcattcaccggaagaatgtcagccggcatgtccgcattttggagtctgtggcggatgcacttatcagaatctgccgtatgaaaagcaggtggagatgaaggaagcgcagatccatgcaatgatggatgcggcggttgatggtgattatatctgggagggtgttaaagaaagtccggtcagagaggcatatcgcaataaaatggaattttcttttggagacgaatataaggacggacctcttgcacttggcatgcataaaagaggcagctttcacgatattgtaaatgttacagaatgcaagattgtggatgaggatttcagacgaattataaaggctgttctggagtttgcgacagatacaggtcttccgtattatcacagaatgcgccatactggatttttccgtcatcttcttgtgagaaaggcagttcgcaccggagaaattctgattgatctggtaacaacatcggaggcacagttagatgaagccagactggtggaaaagcttaccggtctttcttatgatgggaagcttgccggaattcttcatacaaccaacaacagccttgcggatgtggtaaaagatgaaggaaccaaaattttatatggacaggattatttctatgaggaacttctgggactgaagttcaagatcacaccattttctttcttccagactaattcccttggcgcggaagtgctttatgaggcagcaagatcttatatcggtgagacgaaagataaggtaatctttgatctctacagtggaaccggaacgattgcacagatccttgcaccagtggcaaaaaaagtagtaggtgtggagatcgttgaagaggctgtagaggctgcaaaagaaaatgctgctttaaatggactcgataactgtaccttctgggctggagatgtgttgaaagtaatcgatgatctgggtgaagtaccggatctgatcatattggatccaccaagagacggtattattttttgtcacaaattaattataacagaaagaaagaccttgagttcaatataaactcttggtctttcttttttttcgggactattcttttttcacagcccctttttttgcgtatatgatgagtcaggtgcagattggtgcttgcacaagaatctgtatctgacaaatatagatcatctcgcaccacattttcaaatctcaaaaaattcttaagaaaatcccgccctatctcttaaaaaatctctgttagtcttgtatagtatagaggaggtgaaaaaagatggcgaaaatattagtatgtgatgatgataaagacattgtagaagcaatagatatttacctgacgcaggaaggatacgaagtcctgaaggcgtatgatggcgacgaagcgatcaaggtattgaaaagaaatgaagttgatcttctgatcatggatgtgatgatgccgcggctggacggaatccgggcgacactcaagatccgggaaaacatgagcctcccgattattattttatccgccaaatcagaggatgcggacaagattttaggactgaatatcggtgcagatgattacataaccaaaccgttcaatccgttggagctggtagcaagggtaaaatcccagctcagacgttacacccagcttggaagtacggcgagatctgacaaccagagtgagttccggactgggggacttgtgatcagggatgatctgaaagaagtgactgtggacggcgaaaaagtgaagctgacaccgattgaatacaatatattactgttactcgttaaaaatcagggaaaggtgttctctatcaatcagatttacgaaaatatctggaatgaagaagcaatcggagcggacaataccgttgccgtacatatccgccatatccgggagaaaatcgaaatcaatccgaaagagccacgttacctgaaggtagtatggggtgtcggatataaggtagagaagatcggttaggaggtcttatgaataacaaatggtatcagagcgcaccatgtaaaggaatcctgatcgtactggagcatattttagcggtggtgatgatcacatgtctggtttttacattcagttatccgggcgataatctggtaggaatcctgtttgaaaagccacataagaagtatgatcagtcaaaagggtttaccgacaagctgatgagtgctgcaaatgatattacggctgcggaaggatacgacagcaattttgaaacagaaggagaatatgatgaaaacagaattgtagatctgaaagaatatgattcagatcgtacgatttcaaatgaaaatgtaaatgggcttgcataccgtcttggtgatcttgtgaattactgggaaaacgatcaggagatgtactacgcagacgggaccaagatggcagatggagacaatgatgatgagatcatcgtctgccagaaggatgacggaacctaccattattattatgaaaaagaatttcgtcgggaatttaaaaacgggaatcttcagtttggtaatatgggtgaggcaaaagatgaatattcactggaaagcaccggagaagtgatcgattctctgatcaatgactggatcgagagctccgcaagtatttaccgcaatattctggacagtgaaaatcgccaggtctacacaaagtgctggcggtatgacggagaaaaagtttccgaaaactgtgcaccggtgggcgcgaagaatcttctggaagttgtgaacaaggattccagatggaacggcaagttaagtgatgcgatgtccctgcttggaaatactgtggacagtgtacggaatgaatttttgacgtggcagtatgtaacggaagaatataaagaaggtaataccaatcttgcatatatgattgtagatctggacaataaaaaagtttataccaaccgtcttgcatatcagagatttgatgaatgggaaaagaatctggaaagtatgaaaacgctgggagtatatgcggttgccacaccaaagcttactgagtaccagagtgatattgatatggacggatcacagtggaaatcactgatcggtggcaatatgtggatggataattacgaatgcgtgtttgcggtagatacttcctatccaatccaggatgacttttatcaggagagcaagatttatcaggagtatgcaccgcaggtaagatttactttctggattgcgattgcaaccggatttgcaatgcttgtaattctggcatggctgacaattgttgcaggcagatcaaaccgggaagaaggcattgtgttaaatcgggtcgataaaatgaagacagaaatctttattcttttgtcggttgcagttatggtgatatgtatttatggggaaatcagtttaagttacagtctgttgaacggagtctggtttagcggagatggtttcaatggcacatcggtactgatttttgcagggattgttgcggtaagcgtttgcatgacaggacttactttctggcttggaatggtaagaaggatcaaggcaaagactttgtggaagaacagtattttatgtctgatcatcaaatacgtccggattgggatccggcatctgggggaggtctggaaagctgcgattttgtttggagtactggttgtggttcactggatcgcgatcgccatgtgggagccgggaatctggctgttcgtaatgcttgcggcagaggcgggggcatttttctgcctgatgcgcagagccatcggaagagcgcggatcatcaaaggggtaaaagcaatcgcagacggtcaggttgattatcagattccgttaaatggactcaaaggcggacagcttgaagcagcagtcagcatcaataagatcggagatggactggaccgggaggtagaagagagcgtaaaaaatgaacgcctcaaaacggatctgatcacaaatgtatcccatgatatcaaaacgccgcttacatcaatcattaattatgtggaccttttaaagagagaggattttgaggatccgaagatccggaattatcttcaggttctggaagaaaaagcatatcgtctgaagacacttactgaggatgtggtagaagcttccaaggtaagcagtggcaatatcagcctggaaatgatgaatcttaatctggttgagctggttaaccagaccagtgcagagtttgaagaaaaatttgaggcaaggaatctgaaaatgatcatgaatcttccgaccgaaccggcaacaatctacgcagacggcagacgaatgtggagagttcttgcaaatgtatttaacaatgtggcaaaatatgcaatggagggaagccgtgtatacgtggatctggttcagacaggtgaggaagtacagcttacgatcaagaatgtatcagagcagccgctgaatatttcggcagatgaactgacagaaagatttgtccgtggagatgtatccagaagcacggaaggaagcgggcttggtctttcgattgcacagaatctgacaaagcttcaagggggaaaattcgagttatatctcgacggagatctgttcaaggtactgatccgtttcccggttccaaaagaaacggaagatgtctatcaggaagtcgaacagtaacaggtaaatatggggcgtaagggaaatttcccttgcgctctattttatttcgctttacaataaaaactggattcgtacatataacctaaaatgtaaggggaaattaaaatggaatcattgaataatatcttaaaaaagagtttaaataaagaatttttatcagcaataatcagcaatccacgtgaaaaaggcggaattgtaaagattaagatccgccctgtggagcataaagacaatattttgtaccagtgcgaagaacaccggaacaaccaggtatttcaccacaatctgaatgaagaagaagcagcaggatatattgaaaatgccatgcaggaattcaaacagatgcagatggagaccaggaaattccgctatcaggttctggtcagcaaaaaagggaaaatgacgattcagagacggcttcagaccgggaggttcaaagagattgatctttcacacaaccggaagaagcattatatcctggaggaaggaaaagcagttccatttttacaggatctgggagttatgacaaaagaaggggaaatcgtgcggacaaagtttgataagttccgccagatcaaccgtttcctggagtttatcgaggatgttcttccggagctcccgaaggacagggaagtaacgattctggattttggatgcggtaaatcctatctgacatttgcaatttattattatttgcatgagttaaaaggttatgatatccggatcatcggactggatctgaagacggatgtcatttatgcatgcaaccagcttgcaaaaaaatatggctatagaaaactgaagtttatggaaggaaatattgcagattataccggctctgatgaagtggatatggtcgtgacgctgcatgcctgcgataccgctaccgattttgcacttgcaaaagcagttggctggaaagcgaaggtcattctttcggttccgtgctgtcagcatgaagtgaaccgtcagattgcaaatgaaacacttgcaccgctgttttcttacggactgatcaaagagcgaatggcagctcttgtcacggatgctatgcgtgcagaatatctcaagagggagggatatgacacacagatcctggagtttatcgatatggagcatacaccgaagaatattttgatacgggccatttacacgggaaataaaggaaaaaatacagaggcaatccgcacatgtgaagaaatgcttcacatcgatccaatgctggggagattattggatcagcagaatgaagagggagaaaaaggagtataaatttagcagattaagataaaggggactataattacaatgtttaaaaagatagcaataaagacaggggtactgactactgtatttattcttgcagttatcgtatccagttatgtgacgaacagaggcaacactgatatgagtgcagatatgggaggtgcgacattgccaagaatatcctttatgacagaaggatatgaagtgaactcactgccgggatataaaagcgatatgacgcttacttcaatgcgtgatacactgacacccgtcacaaataaccagctggatatgaacattgcaaaatatgataatcagatccaaaaggtttactggcaggtatatacactgaatgggaaaaaatgtattcaggagggaaccattaaagatgttcaggatacagtaactttaaatttcaagaatacgaagatcctgaaagaagagaggattttgaaagtaaccttgtacctggataatcagaatatttatttttataccaggatcaagaattcggcagattgcaactataagaaaagcctggatttcgcaaatgatttccacaatgcggcactcgaaaatcagagtgataaggtcgaaagctatttggaaacagattccagtgaggacagctccacctatcaggaggtcacacttgcatcgacacagtcacaggtgacatggggttcgcttgcaccgcaggtatcgggaaatgtatactgggaaattaaggaatgcaatgagaattacacatcacttgtcctcaaataccaagtaaagtgcaccggggatactgattatgctgatcggctttacagtgtaaaggaattcttccggatccgcaccggggaagatgcacagcagtatctgcttgattatgatcgcacgatgaatcagagatttgatggtaagacaactgcgctgaaccagaaaggtgttcttgttgggattgcgccgacggacctggagtatgagactaatacagatggaaccattgtagcatttatagaggataaccagctctggcattatgataaaaaagaggatgaaatgtcactggtattcggcttcgcagatgcggaaaacatggatgtgcgtacattatgcgacctgcatgatatccgcctgatttcagtagatgaaaaaggcaataccacatttactgtagtgggttatatgaatcgcggtgtacatgaagggcaggtaggtgtagcagtctattattttgacgcagaaaaaaattccgttacggaaaaagcatttgtccctagcgaagacggatattatctgatgaaagaggatctgggtaaatttgtatattacagcaattctgatgaaaatctttatgtaatgatagatggtacattgtatcttgtgaatctgaaggacaacaccagagaggtgctggtgaaagatctggaggaagggcagtatcaggtttcaccagacggacatctgcttgcttaccagagtgagggcggaaagatcaatgagtcgcagaagattatcgtgctgaatctgaagacgggcaaatcctttgatattacatccgaaggagacgaatatgtcaaaccgatcggatttatccggaatgattttgcctatggcacgctgcgtggaagcgatgcaggaaccaatatatccggacagagtgtgtacccgatgtataaagtggatatcatcacgcagaaacaggagatagccaagacctatgaggtacaggatttttacattttggatggctatgtggcagacaatatgatgacacttaatcgggtgaacagaaatgagaatacctatatttcaacaacggcagattatattaccaacaatcaggagaaggaagagagcaatatcacagttgagacctacaatgatgatctgcggggaactctggttcgtcttacttatgaaaatgggatcaaagacagcaaagcaaaaattttaaaaccaaagcaggtactgtttgataaaccgatggttgtcagctttggtaaaccgaaggtaaagaatcagtattatgtatatgcacttggcagtctgcagggggtgtatgaaaaagcatcttatgcgatccaggaagcggagaagataaaaggtgtggtcatttcttcatcacaggaatatgtatgggagtccggaaatacgccggatatttatgaagtaaataatatggatgagttccggacaggagaaggtgagagtacgcttgcagcgtgcctgaaccggattctgaagctggaaggcgcagaagatataaatgcatcaacagagctggaaaacggaaagtcaccggcagaaatcctgacagaagcaaccggtggagaagggtttgatctgaccggatgtacaccggaagaaatccgctatacgatcagccatgagacaccggtgatcgcaatgctcagtgtggatcacgcggtactggtcatcggatacacggatgcgaagtatgcttatctggatccggcagacggagaacgtcattcggctacgcctgaagagatggcgcaaatggtaagcggcagcggaaatgtattttttggttatgtaaaataaatttggaggacgcaaatgagagacgagaaatatttagaacttctggcagaaaaatacccaactgagcaggcggtctgccgagagattattaaccttaaagcaatcctcagcctgccaaaagggacagagcactttatgagtgatctgcatggagaatacgaggcattttgccatatattaaataactgctccggtgtgatccgggaaaaagtagatctgttgtttgaagatactttatcagatctggaccgggaagaaatctgtacgctgatctattatccagttgaaaagcttgcaatgataaaaaaggaaggaaaaaataatgaagagtggtatcgtgtgatcttaggagaactaatcgatatcgcaagattattttcatccaaatacacccgctcaaaagtaagaaaagcgatgccgaaggaatatgcctatattctggatgaactgatccatgtacagaaggatgaagatgataatcagctggtgtatcaccgcaatatcctgaatacgctccttgaactacagaatgcagatgaatttatcgaggtgcttgccggattgattaaacggctggcagtcgatcatctacatattgtcggagatatttttgacagaggtccttgtgcagaccggatcatggatttgcttacgacttatcactccattgatattgaatggggaaatcatgatatcctgtggatgggggcagcggcaggaagcagagcctgcatcgcaacagttatccgtaacaatctgaaatatgataatatgaagatcatggagaatagctatgggatcagtctgcgaaatctgaccttatttgcagaaaagatatacccgcagatcgatccgatggaagcggcactgaaagcaatttctgtacttctttttaagctggaaggccaggtgatcctgcgtaatccggattacaagatggaagataaattgttgcttcataaagtggatgtgaaacgtcaggttgttgaaattggcggaaaagaatataagatcaagaaggaagaatttccaactgtaagttttgcagctgaaagtgtggaagaagtctatcagctgaccgaagaggaagaaaatgtaatggaaggtcttcagatggcttttgtgaacagtatccgtctgcgacagcatatagatttcctgtataaaaaaggaagtatgtaccggatcttcaacgataatcttctgtatcacggctgtgtgccgctggatgagagcggaaactttgacggcgttgtatttgggaagagatgctatcgaggaagagaatatctggactatgcagagcatgttgccagaagagcctggtcgaaggaggcgaaagaaaaagacagagactttatgtggtatctgtggtgcggaagaaagtctccactttccggaagaaatacgaaaacctttgagcgtacttatgtgctggatgagtcgacatggtatgaagaatcaaatccatattataaattctacgaagaagaaaaagtctgcaatatgattctgcatgagtttggtctttattccgagcgtgctcatatcattaatgggcatacaccggtcagaacttcaaaaggagagcatccggtccgtgcgaatggaaaattaatggtcattgatggaggtttctgcaagagctaccataagactaccggaattgccgggtatacactgatcttcaattcccatggtatccggatcaaatcccaccagcctttcctgagtgtgtatgcggcacttacggaaaataaggatatcgagtcaaaatcagaactggtcgagaccgaaaaagaacgtttgatggtgcgggatacagatagcggaaagaagatcaaggaggatattgaggcacttaaaatgctgctccgtgcataccgtgaaggggagttggaatagagtgaaaaagatttttgcatgcgctttatgtgttgtcatgacagttagtttatgcagctgtgcaggatgccggaaaaaggaagaaacaaaagcgaaagagaaagaaaccattgaattatgtcattactgggatataccggataatcagagacatctggaagagttggtagagcagtttaataagatgcaggaggatattgagatagaagtatcttatattccggatgaagattttaaaaaacagcttgccctggcgatgtcggaagaaaagatgccggatattgccgtagtggactcctcggactttcaatttctacatcatatgaaagcgtttgctgatcttacagatgctattccggaattaaaggaatataacgaaaaagcattggaaccatgtacgatagatggaagaatttatgggcagccttttggtgtgaactgtacagggatgttctataataaaaaactcctggaagaaaatggatgcgaagttccggaaagctgggaagaatttcaagagacagcggcgaagatcagcaatgaagatgtaaaagggtttgcgatcactgctttacagacagaagaaagtatgtatgaatttctgccgattttatggtcaatgggaggggacgtgtatagaattgcagaagaaaacagtaaaaaagcatttcttctgctggatcagatggaaaaagaaggaagtctgagtctgcagagcatttctcttaccatgggagatctgacaaatcagtttctaaaaggaaaaattgggatcatgttcaattcctctatggcgattgacagtatcagggaaggaaatccggatctggaattcggtgttgcaccgattccgggaggagagacatcggtttcggtagccggaggagaaattctggcagtagcggagaatgaaaagaaagagtatgcaatccgttttttaaagtttctggcagataaagaccgaatgaaagaatatattgatgcatttggttttcttgcaccgcgtcaggatattatggaacaacaatttgccgaagatccggaaaagagaacatttataaaaatgtataaggctgccgggattcgtgagatttctccggaatggccacggatttccctgacactttccgatactctgagacagatactggtggaggaagaggatccgcagacaatattgaataaaagtgcagaaaagatagagaaaatcggagcagagaaatgaaaaagaaaaatctgagacaaattctgattcctgcatttattattacggcatgcattccgatcactatttttacagtgatatcgcaggcacgtctgaaaaaaagcacccttgataatatgaacaatcaggcagaggcagatcttcagaagtcaaatcagtgtctgaatatgacattggataagtatgagacgattctgtatgatatcactacggctgaagactttttaaatcttgcggttaccgcgaaagaatctgctgatattatggagacagatgcctataatatgcgaagtgaattttctcatatctgtaacagaaatcagggtgtggacgggattcagctggtattggcagatagaaaaagaatcttttatgacaggctttcttcttcttcggtgaacagttcctggattgaaaaggttgcagttccggagacagaagagatgctgtcttatacgatggatcaagagaatgaaaatccggaaaggatgtttcatatcagccgtaaggtagtaaattactgggatatcagtgaagatctgggagaagtgattctgtcagtcgatgcagatgaactgagttccgtgctggatgttggaaaaggatcggaaatatatctgatagatgacggaaggatcgtcggagcggaaaatgaaaaattactgggcaggacggaagatattttagagacgaaaagggtcagtcaaaaatccattacaaatacccggagcggctggaaaatcgtattgtgccagtcgctgagtgaatatcagagagcaatcagagaacagatcgtattctggctgctgctggcagtggcagtgctgcttgtttttgtatttctgatctataaagttacagaaccggtcatggtatcggtaaatgagattgtagatgcgatgaaaaatctggagaaagataatttcagggagaagcttgcaatcaaagaaaatgacagtatagaaatacagaagatatcggaaggcttcaatgatatgactgaacggatctatcatttgatcggtcaggtgaaacaatctgcattggagcagaagaatgcagaaatctcagcgttggaggcacagatcgatcctcattttctatataatatcctggataccatcaactggaaagccattgaaaatgagcagtatgaaatcagtgagatgttagtggcgcttgccgaaatcctgcgttatgccattaatgatgcaggggaactgacaacaatcgaagcggaaaaggtatggctggaaaagtatattcttctgcagcaggaaaaattaggagaaaaaatcgagctgatatttaaaataccggaggaattggaaacttataaaattcataaaatgctgcttcagccttttgtggaaaatgcgatcaagtacagtttccgcggatgtaagggcgaacaccggcttaccatcgaagctgcgaaggcagaagaacaattacatctgatcattgtaaataatgggcagtgtattgagaaagtcagattaaaagaactcaatgaaggaacgaagataaagaatcatctcggaatttccaatgtgagaaagcggttggaactctattacggagaagatacagcagtttattttgaaaatattctttcgggtggcgtgaaagtacatttatttattccgatacagggaggaaatgacgatgcggatagcagtcattgaagacgagagaccgattcgtgaggggcttgtacatattttgaataaaatcagtccggaataccaggtggtaggaagcgcggaaaatgggcgagaaggtttaattcttcttgaagaacaggatccggatctgatcctgcttgatatccagatgccggatatgaacggtctgcagatgttaaaagaagcaagagaaagaggaagtatgactaaggttgtgattcttacggcatactctgattttgattatgcaaaaaaggcaattgcactcggaatagaaaattatctgctaaagccggttaatcttacggaactgaagaacaccctttctaaaatcaaggaagagatattcgtagaacagagagggaaaaattctctttcacttgaaacggtcataaaagatgcgttagaaggcgagtatgaagaggattctaggttagaggagatgcttttggagaaatatggtttctccgacagaaaacaaatttactgtatgtatctttttatgggaaagtattatgattccgaacaaaaagaagcagagctttttttagaagaattccgggaacataatccggacaaaaaaatgtgctggttatggagagagaagaggcagtctgtttttatctgtttttatgatgtgaaagcaaaaaaaaattttatacagtatttgaagcaatcggtagtaccggctttttctatgagaatccatgatcatggggcatttgcgggaaaagagtgtcaagggttgggagaactggtggagattgaaaatgcgctgaccgaagcatgcggatggcatttaatacttggcaaccgggtattgatcaagtgcaaaaaaatcgcgcaactgaggacaaagcgttttacttatccggcagatctggagaatcaggcaaggagtgcggtaatccatctggattatcctgcgtttacccggtgctttcagcaatttatggaggcaggattacgtgaagtccacagcccgcaggaaatcagagaggtttgtatccgttttgcttacgctgtgatcaatacggcaaaagagtgtggaacattacgggatgaagatctgcttgtccaaaaaatattacatacgattttaaatgctgttttctgggaagaaatcatggatgcaatgctggaattatttgtctgcatagaaaatgatgaaaaaaaacagacttcggcagaacttctggtacagaaagctctttctattattaaagaatgctacagtgacggaatcaatctggaggaaacagccaggagactgcatgttaccgaacagtatctgggtacacagttaaaaaaagaaacaggctcttcttttacggagatcataaggcgatataaaatcgcacatgtaaaacaattacttctggatacggaattaaagctgaatcagattgcttcaatggcaggtttttcggatcccaagtacatgagtaaggtgtttaaacaggaagtagggatgcttccgaacgaatatcggaggatgaatacataatcagtttgtaaaattcctctttttataaaaaatttctcctttttaaaaatctgaatttgctatagtaggttcagaaattgagaagaggaggaagtaagatggaagcagtcgaaaaaatttccgtcggagtaattaaagaaaaaacaaaaagtaaagcagtcaaaaaagaagcagaaggtatgcgggtttccaccagagaaaaagtctgttacggagttggtgatatcggagcaaaccttgtgtggacaacggtagcttcattcctgacgatttactgtacagatgtggcaggaattgcagcaggagtagtcggaaccctgatgctgatcgcaagattgtttgatggagtatccgatctttttatgggtgttattatcgataagacaaataccagatggggaaaggctcgtccgtgggtattatggagtgcacctccgcttgttgtcagtctgattatgatttttacagttccgaatatcggagcaaacggaaaagcaatttatatgctgcttgtatatattttccttgcagcagtttgttttactgcatcaaatctttcttacaataccatgctttcgctggtaacaaccgagcagcatgaccgaaatgtaatgaatacaatccggtttgaatttacaatgatcgcacagctggtaatcaatgtgattacgattccgctggtacatttccttggaaacggccagaagggctggacctgcatgagtattatttatgcgatcgtagcacttggaatgtttattacaacatttgccggaacaaaagaaagatataaaccgatcaaaccggaagtgactgaaaagaagaaaacacacccgattaagactattaaaattctttgcagcaataaatactttattctgatcacattagcatttgcaattatttatacatcactcggacttaccggtggatcaagaatttattatgcaaaatatgtacttggcaatgagatgatcaacagtacaatgacattatttaactatatcccaacgatccttacgatcatgctgatccctatttttgcaaaaaaatttggaaagatcaaagcattatttgtgggcttcctgttctatggagcaggacttattcttgaaattgcaggaccggtcaatcttccgatgatttatggaggactggttttacagggaattggtcatgcggcattgtattcctgcctgttcgcaattgttggagacgtagtggattacagtgaatggaaagacggaatccgagaagaaggacttacttacagtgtaaccagctttggacagaaaatcggaacaggtcttgggacagcagcacttggatggatccttgcggcaggaaattataatggaacggcagctgttcagccggacagtgcgatctttgcaattaagagtctgttcttatatctgccactggctatcacagtcgttgttttaatcatctggtatttatttatgggaatcgataaggtatatccgacagtcagaaaagaactggatgaacgtagaaaaaacgcaaaacagaattagaaatataagataaatagtaatagtaaaaggatcggatggcagttcgccatccggtcctttttgtaatagaaaattattttgtcataacgacagcgccatcatccgtaatgcggaccatgtattctacctgagcagaaagtccgtcatcttcggtataaaccgtccagtcattgtcttcatcaacaaagaattccggactgccttcgttaatcatcggttcgatggtaaagatcatacccggaaccagaagcatttcgcttccctttggtgtaacatagcttacccaaggttcttcgtggaattcaagaccaacaccatgtccgccgatttcctctacaacagaataaccatttgcttttgcatgtgaattgatcgcatctgcaatgtctccgagatggttccatggttttgcctgcgcaagtccaagttcgacacattcctgtgtgacacgaaccagtttttcggcacgttcgctgaccttgccgatcataaacatacgggatgcatctgagaaatatccgtccagaatggtagatacatccacattgatgatatcgccttcttccagaataatattttcatccggaataccatggcagatctcgttgttaatagaagtacacacactctttgggaatccctgataattaagcggtgccgggattccgccgtgttcggttgtatagtcataaactaatttatcaatttcggctgtactcatgcctgcgtggatatgagcagctacatgatcaagtacggcagtattgagatctgcacttttctggattccttcaatctgaggaatggtcttgagcatatctcttgtcggaacgatttctcctttatctgcatgatatgcgatcttttcttcgatcataagatggcattttttgtatttttttccgctgccacaccagcacaattcatttctttccatgagaatacctgactttcttttataaatttttacgtgcagagtttgatgtgatcacaaaaaatcagatgtatgcctgcactaactgtttcacttctataatatatccattccggaacaaaaagtcaatctgtgctgtgcatttcgccagatgtgattcaaaatgacagaccaggatgcggtatgtatcggttttgcagcagaactattgcttgtataggactcgggaatcggttataatacaaagggattataactgaaaataacagactgatctggaaaagatgaacagggaaaggatggacaattatgtttagaattggaatgcttaccagtggtggggattgtcaggcactgaatgcagccatgcgaggtgtcgtaaaaggactttgttcaaaacgaaacgatgtggaaatttatggatttcaggatggatataaaggacttatttattcgaactttgagatgctgacagcaaaagatttttcgggaatactgacgatgggtggaacaatcctcggaacatccagacagccgtttaaactgatgcgcgtacctggaccggatgggatcgataaggtcgaagcgatgaagcatacttatcacaagttgaatctgaactgcctagtagtactgggaggaaatggaacacataagactgcgaatctgttaagagaagaaggactgaatgtgattacacttccgaagacgatcgacaacgatctgtggggaacagatatgacatttggctttcagagtgcggtagatatcgcaacggaagcaattgacagaatccatacaactgcaacttcacacagccgtgtatttattgtagaggttatggggcataaagtaggatgggtaacacttcatgccggaatcgcaggcggagcagatattattcttctcccggagatcccgtatgatgtggataacgtagtgcgtgcgatcaagagccgtacagaggcaggaaagcattttacgatcatcgcggttgcagaaggcgcgatcacaaaagaagatgcagcccttccgaagaaaaaattaaaagaaaaacaggaaaagaagggctatccgtctgtggcatatgagcttgcagagaagatccagaaccgtatggatcaggaggttcgtatcacagtgccgggacatacgcagagaggtggaagcccgtgtccgtatgaccgtgtgcttgcaaccagacttggagcagcagcagcagacctgatcttaaaagaggactacggatatatggtaggaatcaagaacggcaacatccgcaaggttccgcttggcgaggttgccggaaagctgaagatggtagatccgaaagcggatatcatcaaagaagccaagattgtcggaatcagttttggtgatgagtaaaggagtaatttaacatgtcatatactgccctgtatcgtaaattccgtcctgcggaatttgaagacgtaaaaggacaagatcatattatcacaacgctgaagaatcagataaaggcggacaggatcggacatgcatatctgttctgtggcacaagaggaaccggaaagacaacagtagcgaagatttttgcaaaggcagtcaattgcgagcatccggtagacggaagtccctgcggggaatgtaccatgtgcaaaaatattgcagccggtacttccatgaatgtcattgagatcgatgcggcttccaacaacggtgtggacaatatccgtgagatcagagaagaggtatcctaccgtccgacggagggaagatataaggtgtatatcatcgatgaggtgcatatgctttcaataggtgcatttaatgctctgttaaagactttggaggaacccccggaatatgtaatctttattcttgcaacgacagaggcacataagattccgatcacgattttatccagatgccagcgctacgatttcaagcgtattacgatcgatacgatcgcagcgcggttggatgaactgatgaaaaaagaacaagttgaggtagaagaaaaagcaatccgttatattgcgaaagcggcggacggatccatgcgagatgcactaagtcttctggatcagtgcattgcgttttacctcggacagaagctgacctacgatcatgttcttgaggttcttggtgcggtggatacggatgtgttcagccggcttctcagacagatcatcagccaggatgtgggaaaggtacttgctaccgtagaagagcttgtgatgcagggaagagaactgacgcagcttgcggcagattttacctggtatctgcgcaaccttcttctggtgaagacttcggataatatggaagatgtgctggatgtatcgacggagaatctggcgcagctgaaagaggaagcacagatgatcgaatccggggtgctgctccggtatatccgtattttttccgagctgacaaatcagctcaaatacgcaacacagaaaagagtgcttctggaagtaacactgatcaagctttgcaaaccgcagatggagagtacgaaggacagtcttctggaccggatccgtgcactggaaaaacaggtagaagaaggaagttttgcagttgcgcagccgcaggagagggttgtttatgtaaatggtgaagcaccgaagccacagccaaaaccgcagcttccgaaagcactgaaggaagatataaagcaggtgacatccaatttccggaagattgcaaacgaagcatcaggcatgcttagaggctatctgaagcaggcaagactcagcgtggacgatcaggacagacttctgatcgttctgccggatgagatcagcgccagcgtggtaggaagcgaagaacataagcaggaattaaaagatctgattgagaaaaaaatcggcaagactgtggagattgatgtgcgtcaggtggagaacggacgccattttgaagacagttttgtggatatagaaaaagtgatcaatatggagatcacgattgaagatgaataataattaggaggatttatagttatggcaaaaagaggaggatttccaggaggcggaatgccgggaaatatggcaaatttaatgaagcaggctcagaagatgcagaagcagatggaagagcaggcaaaagagatggaagagaaaagttttacagcaactgcaggcggcggagctgtagaagtgaccgtaagcggtaaaaaagaagtccagaaagtaaaacttcaggaagaagttgtggatccggatgatgtagagatgctggaagacctgatcatggcagcagtcaatgaagcacttcgtcaggtcgatgaggcaaatacttccgctatgagcaagctgactggcggacttggcggaatgccgggaatgttctagaacgggagtgtaaaagatggattattacagcagtcagatcagtaaactgatcgaagaattatcaagactgcctggtatcggagcaaagtcagccggaaggctggcttttcatatcattaatatgccgaaggaacaggtagaacagcttgcagcgacactggtagatgcaagaaataatgtaagatactgcaagcaatgctgcacgcttactgacaaagaattatgcccgatctgtgccagcgaggagcgggatcataagacgatcatggttgtggaaaattcccgagatcttgcagcttatgaaaagactggaaaatataacggtgtgtaccatgtacttcatggcgcaatttccccgatgcttgggatcggacctggagatatccggctaaaagagctgatggagcgtcttcagggggatgtggatgaagtgatcatcgcaaccaattccagcctggaaggggagactactgcgatgtatatcagcaaactgatcaagccgacaggaatcaaggtcagccggatcgcaagcggcgtgccggtcggcggcgatctggaatatattgatgaagtgacgcttctgcgtgcactggaaggacgtacagcactttaggtgacttaacgtaacttaaggactgcgaggagtgccggaaacgtatgcatttgaaagaagtaaagatatgagaaagaagaaagtaacctcttcggatatcgcacatgcggcaggtgtgtcgcaggcaacggtatccatgatcctgaataaaaaatataatgtatcattttcaaaagaaacgatccgtaaagtggaacagatcgcggaagagatgggatacgaagtaccgaaaagaaagacacgcagagaaagcaggaaagaaaaactgatcgtcgtattttgttccaacctcacgaacccttattatgttatgttgcttcaggggattgaatcccgtgcaaaggagcagggatatggactgtttgtgtgcaatacccagagggatctgaagatggaggagcggtatctcaggatgatgcatgagctgaaaccgcttggcattatctatacctgcaatccaagccattgttttatggatacgatagaagagttggcagaaaaaattccgatcgtaattatcaataaccagaatgagcatctgaatgtagatgcagtggaactggataattccaaactcggaaggatgatggcaaagcatcttctggatctggggcatcggaaagtagcgtatattgcaccacctcttacaaccagacagaagcagcgctccaaaagggtggaaggatttctgaaagaatttgatgctgttggattaaaaggcaatgtgatcatcaaggcagcaaatgagtcgatcgatatgagcatcccgaatatcgattcggagtataagatcggatatgatctgacgaaagagcttttgagagagcataatgatattactgcgatcgtcggattaaatgatatgatcgcatttggaatcctggatgcacttcacgaagaaaaatataaagttccggcagatatttccgtaatgggatgtgataatacactgtttgcgaagatgcataaggtgtcgctgacaacgatcgagcattttgtcgttttcaaagggcgggatgcctgtgatatcattatgaaaaagattctttctcagaacagccagtattcagagatccagccgatcagcacctaccatgtagaatatgaacctcgtctgatcgtgcgtggaacgacgtcttatgcgaaaacaaaaaaagggaaaaattagtttaaattcaaaaaatattagtaatatttcatagtttatgtctctgaaaacgctataaaataaagaattatccaaaaacggtatcaaaaaattactaataaaatagttaatattaacgtgaaaaattactaataaaaacatatggctattgacctgtcagagtaaattgcgatataatttaaccaagtcaggcaatcagataaaaagagagattcctgataacgggaaatacgaattttcatgttcataaggaggaaaacgaaatgagatttttcatcgacacagcaaatgtggaagacattaaaaaagctaacgatatgggagttatctgcggagttacaacaaatccgtcactgatcgcaaaagagggacgtgattttaaagaagttatcgcagagatcgcatctatcgtagacggaccgatcagtggagaagtaaaagcaacaactactgatgcagaaggtatgattgcagaaggtagagaaatcgctaagatccatccgaacatggtagttaaaattccgatgactgtagaaggactgaaagcttgtaaagctcttacagctgaaggaatcaagacaaatgtaacactggtatttacagcaaaccaggcacttcttgcagcaagagcaggggctacatatgtatcgccgttccttggacgtctggatgatatttctgtacgtggaacagaactgatcgaagaaatcgctgagatgtttgcagcggccggagatattgatacacagatcatctgcgcgagcgtccgtaacccaatgcacgttacagaatgtgcacttgcaggtgctgatattgcaactgttccttacaaagtaattgaacagatgacacatcatccgcttacagatgctggtatcgcaaaattccaggctgattacaaagcagtattcggagaataaaatttacaatcggaataatttactgtcggaagagcatcaatttgcgcttccgacaaagtgactaaaaataaactatttcaggaggcatattttcatgaacaagtcagaacttatgaaaactgcaaatgaaatccgtaagagtatcgtgacagcagtacacgctgccaaatccggacatccgggcggatctctgtcagcagcagacatctacacatatttatattttgaagagttaaatatcgatcctaaggatcctaagaaagcagaccgcgaccgtttcgttctttccaaaggacatacagctccgggatactattctgcactggcacacagaggattcttcccggtagaagacctcaagacacttcgtcatacaggatcttaccttcagggacatccggatatgaagcacatcccgggtgttgatatgtcaagcggatctctgggacagggaatctcagcagcagtaggtatggctatttctgcaaaattgagtaatgatgactatcgtgtatacacacttctcggagatggagaaattcaggaaggacaggtttgggaagcttctatgttagcaggcttcagaaaactggacaatctggtagtaattgtagataataacaaccttcagattgacggacgtattgatgaagttaactcaccatacccgatcgacaagaaatttgaagcatttaacttccacgtaatcaatatcgatggacatgattttgatcagattgcagctgctttcaaagaagcaaaagaaacaaaaggaatgccgacagctattattgccaagaccataaaaggtaaaggtgtttctttcatggaagaccaggctggatggcatggaaaagctccgaatgatgaagaatacaagattgctatggaagatttagagaaagcaggtgaagcattatgtcagaagtaaagaaaatcgcaacaagagaaagctatggtaatgctttagttgaacttggaaaactgcatgatgatgtagtagtacttgatgctgaccttgccggagctacaaagacaggaatgtttaagaaagcattcccggaaagatttatcgactgtggtatcgcagaaggcaacatgatcggagttgcagctggtatcgctacaacaggcaaagttccgtttgcaagtacatttgcaatgttcgcagcaggacgtgcattcgaacaggttcgtaactctgtcggatatccgaagaacaatgttaagatcggtgctacacatgcaggtatttccgttggtgaagatggtgctacccatcagtgcaacgaagatgtcgctcttatgagaacaatcccgggtatggtagtgatcagcccggcagatgatgtagaagcaagagcagctgtatttgcagcatatgaacatcagggaccggtatatatgcgtttcggaagacttgcagtgccggtaatcaatgataatccggattataagtttgagatcggaaaaggaatcgtacttcgcgaaggtaaagatgtaacaatcgttgcaacaggacttgaagtgagcgaatctcttgcagcagctgaaaagcttgcagcagacggaatcgatgcgaaagtaatcaatatccatacgatcaaacctattgatgaagaacttattgttgcagcagcaaaagagacaggaaaagttgttaccgtagaagaacattctgttatcggtggacttggaagtgctgtatgtgatgtgctttctgaaaaacttcctacatctgttctgaagattggtgttatggatacgttcggggaatctggtccggcagttgaactgattaagaaatatggacttgatgcagacagcatctgcgaaaaagtaaaagcatttgtaaaataataaaaaaggattctgagaatctataataaaaatgccagaaccggtgtaaatcgggactggcatttttgttatggatgaaagttcttgatccgctgtgggagtgagaaggatacagaaccagatcagtggcactataaccagttatattttgagagtggcatatttcccgttctaggaaaatattttccgtataatacagcttacaagtccaattccgcataatggaagaaggattcctttcagacttccatacagctgcaaaccgccggcaagaccggtcagtggtgatggagaagaaggaatcagattccagaacattccggcagcaattacagttataccgatgaacaggaaagagaaaagcccccgtccggtatcgacacgttttgttcccctgtctccataagcacatggtccggtcagcgcccacaggaagaaaataatctccataatcagcagaaatgctgcgacgccaaggaaggcaccgagcgtataattcttggcatttaccgctgtggcaagtgaaccatataccggataacagctccagaaattcttgaaaatattaaatgcaattatggcgatcatcagaagcgttacgccacgggctccggtctgcaggagtttgccagttatttttgcgcctgtctgcacggtctttttcaccggagtggtgatgatcgaagcggatggagtggaacgctttttcccggaagcttttgaactgccgtttccagagtttccggaagtatgtttccgggcttttttagaccgctcctttcgtgaatcctctgaaggatcttcggtggaagagtgttccttcttttttacttcctcgcttttgttggttttatttacatctctttgagatttctttttacgcctttttacggtatcccgatccggtacgtcatccagatcaatgatatcaaagtcagtatcatctgacaggtcttcataaatctgtttcatgttacaatcagcctcctcatttttgttccgccctattttataccaggaatttgaaagaaacaatatgaatcacagaaacatcacaaaatcataaggaattctttagaaaagaatgaggtggaacaaaagaaattttggtatacttaaagtatgccgggaaaaggaacacggcagaaaaaagagggtaaccagaatggaaaaattacagaaaacgataactgaattaaatgataaattaaaaaagaaaaataaaacaccggaggagcaggatgaagaatttgaacagttttatgaatgcatcaaagatattgcaacccatccggtagtgctgagaatgaagctttatccgcatcatggagtgacaaactgttatcagcactgtcttcatgtttcttactataattatatctggtgtaaggcacttggactggatgcaaggtcagcagcgcgtgcgggaatgctgcatgatttgtttttgtacgactggcatacccatgcaaagcggacaggggatcattttcatgggatgacacatccgaaaagagcgctcatgaacgcagagaaattttttgatctgaatagcatcgaacgggatattatcatcaaccatatgtggccggtcacacttttttctgtgccgcggacaaaagaaggatggattacgacacttgctgacaagtattgcggcagttttgagactgcacagcggaaggagagcgatccggtaaagaaaaaacggggaatggacaggattgtcgaacgattttcctatttagtagacacaaagcgataaaaagtgtgctttccatatgatacgatagcctaaactacaaaatatgcagaatgaggtgagagtattatggaaaacaaatttccaaaaaatgtacgtcagataggaaatgtgagtgatactccgaagatttacgtagaagattatgtagatacatttctgaatcagatttgtgataaagcagataaggaacaggcaggtgcatttctggtcggtaaaaaagaagtaacagaaggacaggagtgcctctatatttttggcgcgatctgcatggaattttccggtgatgaaaatgaaatcatttcacaggagaattttgaaaaagcagagcaggagaaaaaggaatattttgaagatggtacgatgattggctggatgctctgcagaccgggcgtgcgaatggtgatagatacgaagatattcaatacccatgaaaaatatttttccgaaaaaaatactattttcatattaaaagataatgcagaggtggaagaacagtattattgttacaaatataaagagctgatgcagattggcgggcattatgtttagtatgaaaaaaatgctgcaatgcagagttatatgattacggcacggaaaaagattggcgtgacacccagcgaagttgtggaagataaggctgcaaaagactttcgcaaccttgtaaaagaaagatttgaggcgcaggagcagaagaaaacttccaggctgacatacgtggcgagcgtgtttctggtaattgtggttctgatcatgggcgtgacaaccctgaacaattatgggaaaatgaaaagtgtccagtcatccctggaatttatacgtaattcgatcatgaagcagggcgaggaaaaaacacagaaaaccagtggcgcagtaaaagcagtaaatgagcaacaaaatgagaataccgttcagtcagagcagacgaatgatccgcagacagaggaacagcaggatccgatgccacagcagggagaggactctgattctgcttcgacagaggaagaaaaggtcgatgattcttcgatgagcacaatgcaggaaatgagtgaagatatttatattgtagaaaaaggcgatacgctagccaaaatcagcaagaaagtatacggggatagtggacatgtagatgcgatctgcagaatgaacgggttgtcggacggaaacctgatttttatcggacagaaattgattctgccgtagttttctgtacatatgaataaaaactgtggtatactaacaacaaactaacgacaggaaaaggacaggttatggatgtgatagtaaaggtacgtgatccggacgaaaacctggaagaaaagataaaggcgtacaaagtaaaaaagagaataaagacggcggtaacgattttggcgtttgtgtttgcactgatcagcagctatctgcttgtgaaattgcagacatatacaagcttacggactctgcaaagctataaaaataaagagacagaatcaagtgatctgaaatatttgcaatatgcagacggaatgctcaaatacggacgggatggaattgcgtatatcaataaaaaaggtgtagagcagtggaaccagtcttatcagattaaggatccggttatcaatgtgtcgggaaaagcgatggcggtcgcagagcgcggtggaaatgatatttatgttatggatgaaaaaggcgcgaagggagaaatccatacgaattatccgatcgagaagatagctgttgcggaaaatggaattgtcagtacgattttaaataacgaaaattcaccaatggttgtgtgctatgatgcgacaggaaatgtactggtagagcacagagcttcacttaccggaaccggatacccgattggaatcgcactttcgccgaacggaacgagacttcagatttcatatttgtgtgtagcggatggtgtcgaggcaacaagagtcggatacctgaattttgataatacagaagaagcaaacaaagaatatcaggttgctgatgatgtttacaaaaacacaattgttccgacttcgttttttatagatgagaagaagtctgttctggtcggagatcagtcgtttatgatctataaggaaacggacaagccgaagctttctaaaacagtaaagctggataagcagattaaaagctttttccatgacgatgaatatcttgggttcatactgaaagaagaaagcggagaatatgagcttcgcctatatgatatggaaggaaatcagaaattatctaaaacatttaccggggaatatggaaatgtaaagattgcagatggaaatgttatcatgtatgatgggacttcttgcctaatttattccaagcttggtgtgaagcaatttgaaggaacgacagaatatgagataaaagaagtaattccggttttcggaatcaataagtacctggtgatgaatgcagacggacttgcagaggtacggcttgtaaaataggagtagagtatggaagtaaatattttattggtaattgtcgggggcattatagcaataggagccattgtaggatttgccaaaggtgctgtcaggattgctgtatcgcttggggcgacgatccttacgctggcggttgtgtattttgcaacgccgtatgtcagcaaggcaatttattcgcttacaccgattgatgagatggtagaacagcagtgtataaaaacgatgacaaaagccttcacgggagaagcggatacaaattcgggatttacggaagagcaggtacggggaatcctctcagcggcaggtgtatctgagcagacattggaagcagcaggaattaccgtggaagatattgtaaatggtaatgtgtcagatgagatgctgcagcagtatggaatttcaccagatatcttcgatggacatgtgtcaacggaagaggcagagcagtcgatcatggaggctgaggttccaaagcaaatgcagatagtggcaatcgagggggcggatcttccggatgtatttaagaatcttcttctggaaaataataacagtgaagtttatcaaaagcttggggtaacgacatttgcggaatatgtaagcaaatattttgcaaagctggttatcgagattgtcgcgtttctggtaacattcttgtttgcaaccattgtgataagagcagttgtgtttgcgcttgattttgtgacagcacttccggttctgggaattctgaacaggctggcaggagttctggtagggtcgacgatttcatttattatagtagggatcctgtttatcgtaattacgcttctgtatacaacagcgataggaaagcaggcaatgggaatgatcagagaagatcagatccttagttttttatatgataataatataattatgaaaattgcaacaatgttgagataaaaggcttgacaatagaaactgataatggtattataaaaatctgtcacggaaaagtgatggatttttatttataataagggatgtaaggtagtctttgaaaataaaaataaaaacctcaaaaaatgtgttgacaaaacaaaacacacatgatattatatagaggttgtcgctgataaaaataaaaagcgacaaaaaataatttaaaaaagttgttgacaaacatgaaacactttgatataatataaaagctgtcgcatgaaacggcaacaacaaaaagaacattgataactgaacaatagacaacaaaccctgaaaattcttacaagagatttttcaagaacaattaattataccaaaaaatcgctcagacctcacggtctgggcgatttttctgtcaggggagtttttttacagcccctttagagttgacagtccaactttcttgttttatagtgggagttgcaatttggtaggaagtatttaaaagagaggttttggtcatggcacttataaaatcaatcattattttgattatagggtttgctctattgatgaaaggagcagattattttgtagaaggaagttcttctgttgcgaagcagcttcatgttccatcgatgatcatcggtatgaccatcgttgcaatgggaaccagccttccggaatgtgcggtcagtgtaacggcatccctgacaggaaataactcacttgcggtaagtaatgttgtcggatcgaatattttcaacttgatggttgtttgtggagcctgtgcgttatttgcacctcttacgataaaaaaagatacattgaaaaaagagtttccattatcaattatctgtgcggccttgctgatggtgcttggatatgtcgggatgcttttaggacatttagatggcggtgtatttctccttatttttgcagcttatctgatctggatgattggctctgccaagaaagcaagagcagcacacaaggaaagtcagatgatgcgcgaagagggagaattagtagacgaagaaattcagatcctgccactttggaaatgtgcgttatttattgttggcggcatgatcgcaatcaagtttggcggtgattttgttgtagacagtgcttcagcacttgcaagcgcattcggactcagtcagacacttatcggacttaccatcgttgcgatgggaaccagtcttccggaacttgtaacatcgattgttgcggcaagaaagaatgaagtggatatggcactcggaaatgtgatcggttctaatattttcaatatcctgttggtacttggagttgcagctgccatcagtccagtgaaatttcttaccgataatatcattgatacggttgtactgattgcgatgagtcttgttgttctggtgtttgcatggacttcaaaaatgatcgaccgaagagaaggcgctacgatgcttggaatgtatgcagtgtatatggcatatatttgcatacgataaaataaaagaatcataaggaaaaatggctgtggatgaaaccggccccaaaagttagacctaaattctaacgattggaagtcggttcaatccacagctatttttagtgggtcagtgtacattctattttatacttctatagaaaaaacattgacatgtctaacaaaaagaggtataaaaaacgagagaattttgcgacaaggagaaaggcataagatgggaaagtacaattttgatgaagtaatcgacagacatggaacggactgcctgaaatatgattttggaatgaaacgaaagggaagagatgatctgcttccgctctgggtggcagacatggatttccgtctgccggatgagattttggatgaatttcacaagaggatcgatcatggaatctttggttataccgatccactggatgaatattttgcagcaatgaaccattggttctccacacgttatggatatacgatcgaaccggagtgggtaacacttggtgccggaatcgtctatgcactcggaacaagcgtaagagcatttaccgaaaagggagatgccatgatggtgatgcagccggtatactatccgttcagcgaagtcgtcaagaatgacggaagaagactggtgaactgccagcttcgctatgagaataaccattattccatcgactttgaaaagatggaaaaaatgattcgggaagaaggtgtcaaagctctgattttctgtaatccccacaatccggtgggaagagtctggacaagagaagaattagaaagagttgcagagatctgcctgaaatacaacgtgacctggatggtggacgagatgcactgcgatttcattttcccgggacatacgttcacaagctgtatgaatctggatgaaaaataccgtcagatccttgcactttacagttctcctggaaaaactttcaacgtggcaggacttcagccggcaaatattatcattccaaacgaagagctgcgaaaaaaataccagtgggcgaatacacaggccgcttacagccaaggaagcctgatgggacagcttgctgtcaaggtatgctacaccaaaggtgccgggtgggtagatgaactggtacagtatatttacgaaaatgtacagtacatgagcaagttcgtaaaagagaatttcccgaaggcgaagatggtagagccggaaggaacctatctggtatgggttgatttctccgggtacggattcagcaatgaagagctggaacatctgatgctggaggaagcgaaattgtggctggattcgggaattatctttggacctgagacggcgcagttcgaaagattcaatgttgcctgccctcgtgcgactgtaaagcaggcactgacacagctgaaagacgcactggataagcatctggcagcaaaataatataaaaaaaggattgagaggaaaaaagatggacagacaaaagaaaaatatgggggcagtggcatttctcccattgattgtatttctggtatgttatgtagggtgcgggattacatttacactgcttggagcagacgaaccgttcggaaagttcccgcgtcacgtcgcacttcttgcagggtgtgcggtagcacttctccttaaccgtggcattggtgtacaggataagctgaatattatgacaacgagcatgggaaattcaggagttatgatgatcgttctgatctacctgatggctggtggattccagggagcagcagcggcaatgggaggaaaagactcagttgtaaatctctgtctgcattttattcctgtgaaactgttggttccgggtgtatttttaatgtgctgctttatttctacatcgatcggaacatccatgggaacgattgcagcgatggctccgattgcgatcaatgtggcacagggagcgcatttaaatgttgcggtagtcggtgcggcagtgatcggaggatcttattttggagataacctttccatgatttcagatacaaccatttctgcagcagaaggatgtggttctgagatgaaagacaaatttaaaatgaactttttcattgctcttccggcggcaattgtggcaatgatcctgtactcgatttttggcggagtcggaagcggagcaatcgaagcaggaagctatagtatcatcgaactcctcccttattttattgttctaattgcggcacttatgggagttaatgttgcagtagtcctttttgtcggaatacttgcatccggtatcattggactttgtgtcggaagctgtggattttttgaatggatccaggcaattggaagtggtatgagtgatatgttcagcatcagtatcgttgccattcttgtatccggtatcatcggtcttgtacgtgaatatggcggtgttgaatggctggtgggcgcgatcagcagcaagattaagagcagacgtggtgcggaatatggaatcggactgatgtcaggtatcctttccgcagctatggtaaataatacgatcgcaatcattgttacctgtccgattgcaaaagaaatcggggaaaaatataagatcgcaccgaagagacttgccagtctggtggatatctttgcctgcgcatttattgcactgatgccacatgatggtggtatgctgatgattacggcacttgctgatgtatcaccgcttaatgtactgaaatattcgttctatatgtttggactgatcattgcgacctgcgttacgatacagttcggattgatggacaagaaaaattagacaggatgaaatttaaaatatgaaagatctaacaaaaggaaaaccatccacactgatattggcttttgcgctgccgatctttttcgcaaatcttctgcagcttacatacagtcttgtggataccagaattgtcggaactttcctgggagaggacgcgctggcggctgtcggcgcgaccacaaccttaagtaatctgatcattggattcttgcagggactttcggggggattcgcgattattattgcacagaaattcggtgcaaaggattataaaaatgtgaagaaatcattcgcaatgtcgctgaccatgggtacaggaattgcaatattttttacggtgttcggattgttatttttacagccgatcttaaatatactgaatgttccttcagatctgatggcaacggcaaaaagctatattttcgtgatcattgcagggcttgtggcgacatttctttatgatgcatgtgcggctgcactccggtcactcggagataccgtgacgcctcttgtgatcctggcaatctcagttgcactgaatattgttggggatctgctttttgtcgtagtgctgaaaagcggagtgcggggagctgcgatcgcaacggtactggcacaggcaatcgcgtttgttgtgtgctggatttatatggtaaagagatatgaactgttaagacttagccgggaagatttcaaagatccgaatccggttatggtgaaaaatatgttgggtgcgggaatgtccatgggattcatgagttctctgatcaatatcggttccctgacgcttcagacagcgatcaataaacttggaaatgattatatcgtagcacagacagcggcccggaagctgactgaaatgttcatgatcatgtttacagtatttggaaatacgatggcgacctactgtggacagaaccttggagcaggaaagatcgaccggatcaaaaaagggatctggcttgcgattttctatacttgtatctggtgtacacttgtgatcgtggcaagctatacgattggagataaactggtctatctggtaacaggtacacataatgaaaatgtgatcttaaatgcgaccagatatctgaaatttgatacattgttttattatgtaacagcagtaatctgcattgtgcgaaatgccatgcagggactggatgaccatattacaccgatcgtatcaagtacacttgagatgcttggaaaaattgtgatcgcatttacactggttccacatcttggatacacgggggttatcattgcggagccgattgtgtggtttgttatggtgattccgctgatcgtgcagattttccggatgccggtgctgaagcagacaagcctttcttgacactattcatacgcctgtgctagaataggcttgtttagaaaaataaatacagatgcgtaaggtgtcaatcagacggaatgtctggattggtgaaaagggaaacaggtgcaagtcctgtatgaactcgtcaccgtaatttgcaagcttaggctgtcataccactgggagaccgggaaggaaagccacaagcgtctgagcaatcagtcgggagacctgcctttcgcagtacaggaacggaaagttcatgccacgagtaactggcagtacgaaagatagaaacttcagactgattttgcgagggcaaaatgtcagtttcttttttgtacgccctcgttaaatttagatacgggggatttttttgtttacaaaaaatatgctgtaaagtgtaatgaatatcattccgattcctgaaagtatgacaaaaaagtcagggaggatcaagatgaagaaacgagtattagtagcattactggcaacagcacttacggtgtctatgatgactggatgtggaagcaagaagacagaggacacttcttctacaaagacagaagaaacatccgaagacagcgatcaggaggcagcagacaaagtggcaaagctgatcgatgacatttatgtgcaggaaagaacagacaagacagatgaacagtgtaaggctgcaaaagaagcctgggataagcttactgatgcacagaaagaactggtagaaggcgagaacgctgatccggattattttggaagggatacaggcgatgcatcgaaagatgattcgctgaacgaagataacatcggagaaaatgaaattctggttgtaagctttggtacatcttttaatgacagccgtgcagaggatatcggtggtgtggaaaaagcacttcaggcagcatatccggactggtctgtaagaagagcatttacagcacagatcatcatcaaccatgtacaggcccgtgatgatgagaagatcgacaatatggatcaggcactggaaagagcagttgacaacggggttaagaatctggtcgtacagccgacacatctgatgcatggtgccgagtatgatgaactgacagaagcagttgagaactacaaagataaatttgaatctgtaaaaattgcagaaccacttctcggtgaagtcggagcggatgaaacagcgatcaatgaggataaagcagctgttgcagaagcaattacagcagaagctgtaaagacagctggatttgacagcctggatgtggcaaaagaagagggaaccgcatttgtatttatgggacatggaacttcacacacagcaaagatcagctattctcagatgcaggcacagatggaacaacttggttatgagaatgtatttatcggaaccgtagaaggcgaaccggaagataccgcttgtgaagcagtaattgaaaagctgaaagatgcaggatacaagaaagtaatccttcgtccactgatggttgtagcaggagatcatgcaaacaacgatatggcaggcgatgatgacgattcttggaagagccagtttgaagcatccggagcatttgacagtattgatacacagattgcaggtcttggtgagatcgatgcgattcagcagctttatgtggcacatacacaggctgcaattgatgcagaataaataaaaaaagagggatttataagatgaaaaagaaactgttagtattggtattatctgctgtaatggcagtgggaatgatgagtggatgcggtgcaaaagatgaggcgtccgattcaaaagcagaggcaacaaaagatgtttcagttgtagaagatcaagaacaggaaactgtagaatgtgaacttgaagatggaacctatacggcagaattcaataccgacagcggaatgtttcatgtaaatgaagcgaatgacggaaaaggaacactcacagtaaaagacgggaaaatgatgatccatgtcagcctggtttctaagaatatcgtcaacctgtttgaaggaacatccgaagatgcacagaaagatggtgcagaacttctggaacctacaacagatacggtaacctatagcgacggtgcaacagaagaagtttatggatttgatattccggttcctgaactggataaagaatttgatgtggctctgctcggaaaaaaaggagtctggtatgatcataaggtaagtgtgaccaatccggtgaaagtcgaagaataattgaagataagtgaaaggactgtttccctgagaaatgggaaatggtcttttttttgcttgggcatgaactggataacactatacttttatatgtcagatagtgtatactaggcagtggaagatcatacaaaagagagaatgttttgtatataaaaactaaaatgtggagaggaagttaaaatacgatgtactacgtaccagatggcacaaaagagtgtggattttatgaatgtaaaaaatgtgggaaccgtttcttatccttacagacaatgaaccggatcccatgtccggaatgtgaggcagagatcgactatgagatcggaccagacgaatccatggaagatgctctggacacggcagaattactggaaaagatcatcggtgaagaagaagtagagaaaatggatggacttctgagtcttgcaattaccggtggagactgtaactggatttaattttcggttaaaagtgttgaatgggtggttaggaaaaacaaacgaagtgtgttataatagaaatatgagtaaaagagggagaaaatagatggatattcatgatttgaaaatatttctgatgatcgcacaggaaggcagtgtttccggaaacacgtacaggaatggctgcaaaagattcgctcaggagagattacacgataagaaaaaagttgataagtagtaacgaaaagttgcgggtaagtcacaaactatacagaatgcatgaaaaagcggagtatagtttgtggcttttttgtcgacaattccatggaaatagatgatgactataataatggaatatttatagaaaaattgaatttgaataaaatgtacaaaaggatataatggtaatacatggatgctggcaaaatatacaaataatcgcgctggcataaatatattttttacaggaggatttgaaaatgaatatcggggtaacagaaatcagtccaagagaagtgcagagaaaggcagaaaagtgttttaaagacggttactattgctgtgaagctttagtaagtacaatccgtgatgaatttaaactggatgtaccaaaagaagtaatcgccatggcatcaggaatggctgtgggagcaggaaaatccggatgtgtatgtggtgcatttaacggaggaatccttgcacttggactttttttcggacgtacagagcaggacggacctacaaatccaaagagcgtgaagtgcatggaactgacacacgaacttcatgactggttcaagaaggcaaatggtaaaaatgcaatctgctgcagagttcttacaaaggaattcaatatgggacagggtgaacacaaagaacagtgtatctattttacaggactttgtgcatggaaggtagcgcagatcgtctgtcgtgagcttggtatcaagaatctggatgaaattgatgaaccgtgcgaaagaagaaaaattgcagatatctaaataaagtggtaacgacagccgcttgatgagagaaagggaaagaaacaatgaaagacgtaattaagaaagtaccgattccgctttgcggagtcatgcttggcgcggcagcacttggaaatttacttcagagctattcagaaggaatccgttatgtatgcggtatattcgcagcatttcttctgatactggtgcttttgaagctgatcatgttcccgggagcagtgaaagaagatatgggaaatccgatcatggcaagcgtatcaggaacatttccgatggcacttatgattctcagcacttatgtaaaaccgtttatcggaaaggcagcttattacatatggcttctggcaatcattcttcacatcattctgatcatatactttacggtgaagtttgttctgaaacttcagatgccgaaagtatttgcaagctattatattgtatatgtaggaattgctgtagcggctgttacagcaccggcttatgagcaacttggaatcggaaccgcagtattctggtttggatttgtaacactgatcgtacttcttgtacttgtaacctatcgttatgtgaagtttaaagaagtgccggatccggcaaaaccgctgatctgtatctacgcagcaccgaccagcctgtgtattgcaggttatgtacagtccgtaacaccgaaatcatacggtttcctgatggcaatgtttgtagttgcaacggttatttatatttttaccctggtaaaagcagtgggatatctgaagatgccattcttcccaagctatgcagccttcacattcccatttgttatcagtgcgatcgcaagtaaacaaactatggcatgtgcagcaaatatgggacatccaatgccattccttcagtatgtagttctgattgagacaattattgcagtagcacttgttgtttatacttatgttcgctttatgggggttattttcggaggaaagaaataaaagatttgaccggacagataaaaaagggtaaacttaaatttatcaagaatatgtcggatgagggacgtcctagacaccgcaaggggccgaagaagcaaagcgtaaggtaacatcttcctttcgtggaaactgacaggcaaaaaggaaggcgacctgacgaatctttggagagtgtgcaaagaaagcaccacctacgaggctagaaccaactggtaaaaggacagagaaaacagatgaacgatttttttcgtgtatctgtttttttctgccctttttatatggcactaatatgagatgagactgttagcaggcagtacatggtggcatacaaaagtattatccgagaaagaagggaaagggcattttttgaataaaatttgacagaagaaaaagaaaagcaggaggaaaaaaagatgagaatgatgcttgtaggagccggtgctgtcggtgaaagtattttaaaagtaatgcagtggagagaccaaaagggagaatggctgaaatatgtgctggtctgcgactatgatctgaaaagggcagaggaagttgtcggtatgatgaagggggattcccgttttgaagcttctaagatcgatgcaacaaatacagaggaaatggcagaactgatccgggagcataagattgattttgtgatggatgcagcaccaccttttgcaagtaatatgatttttgacgctgcatttaaaacgggtgcagattacggaagcatgggaacctggtcggttccgatggaagatccggcttacggacttggtattgagaacagctatactgaaccgatgacaaaatacaattttgaccgtcatgaagcttggaaaaagcaggggaatatggctgtgatctgtatgggaatcgatccgggtgttgtaaatgtatttgcaaaatacgcggcgacagagcttttggatgaaattacagaagttcatgtaaaagatggcggaaatctgtctgttccgggtgcagatccggatgacattatgtttggattcaacgtgtggaccgtgctggatgaggtaatgaatccgaatgttgagtatgataaggaaaagggtggatttatcgtagaaaaagcatttgcagggcaggaagtctatgagatgccggaaggagtaggaaaaaatactctggtaaaggtagagcatgaggaagttgtgacgatggcacgctacttaagccagtatggattgaaaaaggcaaccttcaagatcagtcttgatgagaatctgatcacggcacttaaggtgctggataagctgggacttcgcagtatcaagccggtgcaggtaggggatgtgaaggtagttccaagagatgtggttgcagcctgtgcaccacagccaaaagatatcggagatgagatgaccggaaaaatgctggtcggagtacagtgtatcggaaagaaagacggaaaggaaaaagaatacttcttgtatcagccatttgataatcaggagtctatcgaaagatggggaacccaggctgttaccgcccagacaggatttggagcagcacttgcactggagctgatcggaagaggaatctggaaagaagctggagtctatgcaccggaatattttgatccgaaaccataccttgaattaatgaaagaaagtggttataaatacggaattatagagaaataatctggatgcgctcagagatggtctgagaaaataaacaaaataaagttacgcgcaaaacggtacaaagtcatagaagaactttgtaccgttttgtgtgtgacaggaaatcagatcaacttacactctttggcccatttggtgacaaaggtaagaaacttatcaagtgcaggagagagttcaggtgtatccagataggctacggacagattcctgcggaagtgttcggtaaaggaacggacacagacgttgaatggaatattatgaagcagaagtttgggaagtacagtgatgccaaagccctgttccaccattttaatcgcagtatagtcttcattgatccgaaatcttacgttaggcgtgatatggtttaatcggaataattttccggtttcataatcaaaatcatcggcggagagaacaaaatcctgtccgtcaatatcggcaaaagataccgtcagctgatcggcaagaggatggtccagggaagtaaccagaaccagttcgtcggtgccgacaggcagatttgggaaatcctttgcgacatattgcgaaacaaagatacagtccagttcttttttgcgaagcttttccgtcaggttctgaaatccgtcaacatagagccgaaaggtgatattcgggtattcggcagaaaaatttttcagtactccggggagccagttataggcaatgctctgcaccgttccgatgcggataaaaccactgtccagattgttgatatttgagacgatctgatcgatccgtgtattggcggagcggatatgcataagttcttcaaagatgggttctgttccgggaagtgcttccattccgttttttgaacgcttgaacagcttaagaccaatctctttttcataattgcggatagtctggctgacagctgactgtgtgtagttgtgtttttgagcagcttttgagatgctctgattctcatagacatcaagaatcacatcgtatttagacatgatgaaacctcccgtggtgttgataaacaatgctcttttactatcttacttaatataaggaagataatcaatatctgtgggattttattataaatttttttaaaatcaaacataagaaaaagtgaaaatataagcgcaaatcaaagagttaacaatgtattaagaaaaagtgaagtctgatatcagttttacagacttttcaatgaccggaaactggaatagcatagaacaggggaatgaaattcaaaggagtttaagtgtatcatgaattaaaggagaagaataatgggatacaattactggaacggaacagaagcggcacaccgccgtgttatgatgaaggcggcaggatattcggatgaagatatccgtcagaaaccgcatatcggaataccgaattcttacatggcaggttctcccggaactgcgcatcttcgccaggtgacagaagctgtaaaagagggaatctgggcagcaggaggaatcccggtagaattcggaatcccggctacttgcggaaatgtggcaaatggtgcggatgagatgaagtatgagcaggtaggaagagatatcgtggcaatgtccatcgaatttgtatccagaatacataatttcgatgcgatctgctgtgtggcatcctgtgatctgatcattgctggatgttatctggcagcgtgcagactggatattccggctctggtagtgaccgggggatcaatgcaggccggaaattactgtggtaagacagttgtagaggcagatctggatgcggcaagattctcaggtgcttccgaagctgagttatttgaaatggaagaaagcgtctgcccgtcattcggtgcctgcccgtccatgggaacagccaacacgatgcagatgttaggtgaggtattgaaccttgttatgccgggaacatctacgattcctgcatcagataatgcaagacttcgtgctgcaagaacagcaggaaaatacatggtacagcttgccaggtccggaaagacaccaaaagatctgatcaccaaagatgttctggaaaatgcgatcatgtttgatatggcagttgcaggatcaaccaatgcggtactgcatatcctggcatacgcatatgaacttggtatcaagcttacactggcagattttgaaaagtatgcgaaggaaatttactgcatcaatgcagtgattccaagtggaccgtatacagttgtagattttcattatgccggcggtgtaaagcaggtcatgaagcagcttgccggtaaaatccataccgatgcgccgacgatttacggggatacaacttggggtgaactcctcgattctgtgaaaagcgcgccaaataaagtcattcattcgctggaagatcctgtagcaaaagaaccgggacttaaaatcatgcggggaaatatttctccggcaggggcgatcgtacgtccgacagcagtatatgaagaagtaaaatacatcaaaggtgcggcaaaagtgtatgaatgcgatcaggatgcatatagagccattatggcaggcgagattgttgcgggggacattcttgttatccgctatgaaggctgtaaaggagcaccgggtatgaaagagctgatgcttagtatcgatgcgctgatcggacttggacttgataaaaaggtcgggcttatcacagacgcgcgtttctccggattcaactacggagcaatcgtcggacatgtttctccggaagcttatgacggtggtgtgatcgctttgatcgaaaatggtgatgaaattgagatggacattgcagggggaaccgtcaatcttctcgtatccgatgagattttagcagaaagaagaaaatcctgggtacgtccgccgcttaagcagcagaagggtgttttaaatatttacgcacagaactgcagaccggcagaagaaggcggtgcaatgcagccatgggcactggatgcagactacggatatcatcacgaataaaagtattggtatggataaggagagaacgggtatgttattgctttcaaaagaggatattaaaagtgtaattacaatgaaagatatgatcgaagcggataagcaggcatttaagatggttgtcgatggtacggtagatacaccgcttcgtacagtcatcaatggaaaatatgacggcgcatttctgtttatgccggcctatgctccagaattagatgcagcagccatgaaggtgatcaacatttttccatacaatatcgataacaatctgatgacatcaccggcgcagactatgctgatcgacggaaagacaggatatgtgatcgcgatgctggatggaacttatgtgacacagcttcgtacgggggcctcttccggtgcagcattcgatctgcttggaaaaaaggaatgtaaaaaaggtgcaatgatcggtacagggggacaggcagcagctcagcttgaagcaatgcttgcagccagaaaattggaagaagtaaagatctttgacctgaatgaagaaagatgcaaagcatttgccgaagaaatgcagaagggactggctaaatacggtgcaaaaatcataccggccaaggattcagatgactgtatcgaagatgcagatcttattatcacagtgactccttccgcaaaaccggtatttgacggaacaaaggtaaaagccggtgcaaccatcagctgcgtaggtacttatgagccccataagcatgagctggatccggcagttttaccgagagcatctaagattatctgtgattcaaaagaggcggcgctttcagagacgggggatcttctgattccgattgcagagggaatcattacagaagaggatgtgcttggaagtcttggagatgtgatcaatggaaagatcaaaggacgtgaaaatgacgaagaaattatcgtatatgaaaccgtaggagttgctgcgcaggatctggtggcagcaaaggtgatttatgataaggcagtagaagccggaaaaggacttcgctggggagaataatctaaaaagaggatgtaaatacaaaaaacacggaatatttccgtgttttttgtattttaaagaatagctttgtgataagataaatgagaacaataatttaaagaaaaggaaacaagagaaatgctaactacatggattcaggcagtataccaatttttatggggagatcttttaaggataccacttccgggaggctcctcttttggtgtgtcactgcttattattttactgattcccacaggaatctattttacgatcagaacaagatttttgccggttcgtctttttggcgatatggttcgcgcacttaccgggaaaaagaaggaagatggcagtctgtcgacttttcagacactgatcgtctcaactgcaacaagagtcggaatgggaaatctggtaggagtagtcgctgccgtttccgcaggtggtgccggtgcggtattctggatgtggatcacagcagttatcggttcttcaaccgcatttatcgaggcaacgctggcacagctttataaagagaaagatccgctttacggaggctaccgcggaggtccggcatattatatgcatcattatgtagagagacggacaggaaagacaaagaaacatgtctgtattgcggtgctctttgcaatctcagggcttatctgctgggccgggatcagtcaggtgatcagtaattcggttgcatcttcttttgaaaatgcatttgggattccgccaatttttacgacggtgattctggtagccgttgcggcagtgatcgtactgcgaaaaaatgccacagtaaaggtgttggatattctggttccaatcatggcagtctgctattttgtgattacgatagtcattatcttattgaatatccgaagccttccgggtgtatttgagcggattatccaggaagcgtttggaatccgtcaggcagcagccggagggttcggagcagttcttatgaatggtgtaaaaagagggttattttccaacgaagcgggttcgggatcagcaccatgcgcagctgcggctgcagaatgtgatacgcctgtaaaagcaggatttatacaggcattgggtgtatttatagatacaattgtgatctgcagctgtacggcgatgatcatgcttcttgtgccggaaaagatgatagcaggactggaaggaatggagcttttgcagacagcaatgaattatcatctcggtaaatttggcgtgatctttattgcggttacgttgttccttttcagcttttcaacgtttcttggaatcctgttttatgcaagaggaaatgtggcatatcttttaggggataagtggtgctggcagacagcatataaaatcctcgcacttgtgatgctctttatcggaggaattgcggcttatcatattgtatgggatcttggcgatgtgggaatcggacttatgacgatttttaatattgtgactttgtatcctatgggtggagaggcactggaggaattgaggaagtacgaaaaaaataaacagtaggagaaactggagaatgtcaaaagatgaatatttaattacagatgcgcctcttaaagcattaactgtttttgcaatgcctatgattttaggcagcttttttcaacaagtatataatatggctgattctattatcgtaggtcagtttgttggttcgtctgcactggcggcagtcggtgcctgcgctgcacttacgaatgtcttcatttgtatagcattgggtgcaggtgtaggtgcaggagtgctcgtgagccgttattttggagccagagattatagtaaaatgaaaacaatcgtgtcaacatcattgatcagcttcctgattctaagcgtacttctgggtatatttggcttttgtttttcccattcgatgatgagtttattacagacacctgctgatatactggatgaagcagtactgtaccttcgtgtttattttgtgggatttccgtttctgtttatgtataacatcctttcaacgatgtttacctcgatcggtgaatcaaagatcccattgggactgttgatattttcttctattttgaatatttttatggatctctggatggtggccggacttggtttgggggtatttggtgcagctcttgcaaccctcattgcgcaggggatttcggcagtgttttcacttttgattttctttagccggatgcgtcgatataaaagtcattttgactggtttgatgggaaggaattgcattccatgcttcggatcgctgtgccatctgttcttcagcagtctacagtgtcaattggcatgatgatcgtacaggcagttgtaaatccattcggtacacaggcacttgccggttattcggcaacgatgcgggtagagaacgttttttcactgatttttgtatccattggaaatgcagtttcaccgtatgtttcccagaattttggtgcaaagaaaatggaacgtatcaaaaaaggatatcatgcggcactggtgttggatttatgttttgcagttcttgcttttatagtcattgaaacgctgcatacccagatttcctcgttattcctggggaaagacggaaccgccctggcatatcaggtgtccggggattatatgagatggcttggttactttttcatttttatgggtatcaagatggcaacagatggagtactccgtggacttggtgttatgcgcccgtttctcgttgccaatatggtaaaccttgcaatccgcctgacagttgctttgatttttgcacctcgttttggtatcgaatttgtctggcttgccgtaccggctggctggtttgccaattttgtgatttcctatgtggcacttagaaaatcgtggccaactgataaagcagcttcagtttgctaactgtctgtttattccggaaatagaattacccgcaccaacggtgcgggtaatagcataagtcagcaagaatataaaatcagaaatataatgccgaaaatccttatggaagcggatgacctgcagccaggtacagctcataccattcttcgcgagtcagtgttatctcacatgctgcgataatttctttcaggcggctttcgcttgcagttccggtaatgatttgcatatttgccgggtgacgtaaaatccacgcagccgcaatggtagtgtcgctgacattatatttttcagccagtacatgaagcttttgattcagctccgggtattcgtcacttccgagaaagcatcctttccatgccggcatctgaaatggtgaccaggtctggagggtgatatcatggaggcggcagtagtcgagcagacttccgtcgtggtcaattgaaccgggggtttccatattgacttccatgccatttgcaacaagattggaaaccggaatgctgaattgaacctggttgacaacgagcggttggcagacatacttctgtagcagtgcaatctgcatcggtttgtggtttgaaacaccaaaatggcggacctttccgctctcaaacagaacatcaaatgcggcagcaacctcttccggttctacgagtgcatccggacggtgaagcagcagaagatcgagataatctgtctgaagccgttttaaaataccatcgacggatttcaaaatgtgctcttttgagagatcataacaaccttgccggatgccgcattttgactgcaggtaaatatcttcccgtttcagggatggatcgccggcaaaggcttcgccgaacacagtctcactcatacctccgccgtagatatccgcgtgatcgaagaaatatgcgccctgttccaatgcagagtgaatgaaatggttcatttcctccttcgatttttcagaaagtcgcatgcatccgactgcaatggaaggaattttttgcaaatgattgcctaaaatagtttctctcatgataaaaatctcctttgtaatgatttgatattcgcggaatttttccgtaaagcaagtatggaagaagtccggaagtacagaaataataattgttatacttttgaccatagtatcatcatatcatagaagcgcactcgagagtcaatgaaaatttcttgagatagctattaaatttgagtaagagatagaagagcagatattatatcttgaaaaaagtacgttccaatggttccgttgaagtcaatagattcctctttactttcccgacacaactgctataatatatcagacagcaagtaaaggcagaacagagaggaattctataatggacattatacaaaaatttggtaacgcagtgagcagtatgtctctggaggatcccgggaaggcgcgcaggcttcttcttacaggataccgacttcaggagaaacgactgctctttttttcagataaaaagctgcccaaatcgggacagtatgtagcaagaattgttatgaaaaatatcatccaggcactttcaaagcctgaaaattcagcgatggtcagcatctttgttccgggagagcttttgacggcggcagggctgactccgtattcggtagaagcaatgtcctgctttatcgcgggaacaagatgtgagcagacatttttgagaaaaacagaagaagagggatttccggaaacgatgtgctcctatcacagagttttccttggagcggcactatccggacttgtgccaaagccaaaatgtatgatctacacaaatctggcatgtgacagcaatatgatgaccttcccgtatctgaagcagaaaaatatgcttccgggattttttatagatgtaccatatgacaagaacgaagattctgtaaaatatgtggcagatcagctccgggagttgaaagcatttttagaagatgttactggaaagaaaatttccgaagaggcagtacggcaggcggtcaataacagcaaccaggcagccgcatattatcatgaacagctggcactgcgcaaagaacatgatccggtcacgagcctgaccaatgagctgtacgcgattttcatgtgccacctcatggcgggttcgcaggaggcagtcaagtacacgaaattgcttctggaagatgtgaaaaaggcaccgaagagcgaaggtctgcatattctctggatgcatatgatgccatttttgcaggaaccggtaaaggatattttcaattacagtgaccagattcatatcagtgcctgtgactttgtagcagacggatttcagaagacacattatgaagatccgtatgagtccatggcagaaaagatggtgaactgcatttacaatggaagcgtcaggcagagaatccagaaggcaaaagagcttgcggcgcagacaaatgtggatggaggaatcctttttacacattggggatgcaaaggtacgatcggagcttccagcctgatcaaagaatcgcttgaggaagcagggatcccgaccatgatccttgatggagatggatgtaatccggcaaacagcagtgatggacagatttctacaagacttcaggcttatatggagatgctgaaggtaaataaagcagaaaaatatgccgcaaatcacggaaagggggctgggtcagatgatacattatgtctgtaaatatacgccggtagagttattgaatgcatttggagaagagtgtgccgtactggaggaaatgccggagaactttgaaatgtcggatcagatcgcacacgcaaatctgtgcggctttgggaaatctgtgattcaggcagttctggaaggaaaggtcaagcagcttgtacttgtgaactgctgtgattctgcgcggagagtttatgatattgtagagagcaccggaaaatgcaattttttatatatgctggatcttccgcatgaggataatgaatgtgagaaggtaaagtatgcacaggcaatcatgcgcctgaaaaaagcatacgaaaaattttccggaaaaacatttgataaggaagcatttttaaattcatttacagaaaatgagacagaaatgaagccatacattggtctgatgggtgtgcgtgtaacgggtattcttgaaaaaatgatccgggataatattcagatggacgtggacaatcttacctgcaccggtggaagacagcttgcagttgttccggagcagatgagacagatggatgaagaaaaaatgtttctggcttatgcggatgccctgctttgccagatcccatgtttccgaatgaataacaacactcggagaaatcagctgtatctggatccaaacctgaagggaattatttatcatacgatcaaattctgtgattattatggatttgaatatgcgagcattaaaaagaatattaaagtaccgattctgaaaatcgagacggattttacaagtcagagcgctggacagttactgacgagaatccaggcgtttgcagagacgattgaaggatcggaagatatggatccgggaaaaggaatcagtgaggaggcaagaaaaaagatggagtcaggaatatattatgtagcagggatcgacagtggctctacaagtacagacgttgtgattctggatcaggacggaaaaattaaatctacgatgatcattccgacaggcggcggagcgatgatgagtgcggagaaaagtctggatcttgctgtagagaaggcaggaattaagaaagaagaaatcgttagaattgtcacgacaggatatggacgtgcttatattgaaagcggggatgacagtattacagagatcacctgtcatgccaaaggtgcgcattacctgaacccgaatgtgcggacggtgatcgatatcggcggacaggatatcaaggcgatcagcatcgatgaaaatggtgcagtaaagaatttcctgatgaatgacaaatgtgcggcaggaaccggaaggtttctggaaatgatggcacggactttgggactttctcttgaagagatgagtacaaaaggattggaatggaaggaaaatattgtgatttccagtatgtgtacggtgttcgctgagtcagaggtggtatcacttgtggctcagaataaagatgtggcagatatcatccatggtctgaatgtgtcggttgcttcgaaagtaggagcactggcggcacgtcttgggaaaaagaatccgggagaatatatgatgacaggcggagtggcaaagaatcctggaatcatcaaagcactggaagaaaagctggatgcaaaattgtatatttgtgacgaggcacagctttgtggtgcgcttggagctgcattgtttgcatatgagaagtgcagtgtgtagaggctgtgtttgtaatcaccggacattattttatattgcataaaaaagagaaaccttaccaattttcagacgtaaaaactgaaaatcggtaaggttttttacgcatatcgccatgcaatatgcaattatcttttatttcattgcatttttaattgcgccaagcagctcttcataggtttcatatgccgggatctgcggataatccgctttgattttgtcggttgaacggaataaaaatcctgccttacttgcctggatcatacccagatcgttgtaagaatccccacttgcaatcgtttcaaatccgatggattgcagtgcctttacggttgttagtttggaattttccacacgcattttgaagtctgtgatctcgccgttttctgcaatttccagactgttgcagaaaagcgtcggatgaccaagcttttccatgagcggcattgcaaattcggtgaaggtatcactaagaaggattacctgggtgaaggaacgtagctcatccaggaagtcttttgcgcccggaagcggatcaatcttggaaattgtttcctgaatttctttgatcccgagaccatgcgcttttaaagtatccagtctccaacgcatcaatttgttataatcaggttcatctcttgtggtccttttcagttccggaattccacttgcttctgcaaatgcaacccagatttccggtacaagtactccttcgacatccagacaagtaatatacatatgttaaccctcctgtactttctgttttttgctttctatcataccatatatctgtttattttgcattcttttttgtaattgatcaaaaattgtgggagagaaacctgtataaactgcatgatggtatggaaaaccatgtaaagaagtcagtcgggaaaattgcgggttccattttggaatgtgtgcaaaccggaaggatattgacgataaattttttcagggactataatataagtatctgtggcaaaagagggatgtttcggaatggattattgaaaaaagaaaatctgccgaaacatattttgcttaaattacataaaggagaaaaaggatgaataactttatttttgaaaataaaacgaaagtatatttcgggaaaggatgtgtcggcgagtatctgccgaaaatcgctgcggtgcatggggataaggttctgcttgcctatggcggcggctcgatcaagaaaaatggagtttatgaggaagtcatagcggcacttgaaaaagccgggaaaacgatcattgaatttccggggatcatggaaaatccgacttataagaaggtgcttgaaggcacaaagctggtaaaggaaaaacaggtggactggatccttgcagtcggcggcggttcggttatggactgtagcaaggcaatttccatggcagcggtcagcgagaaagatgtgtgggatgagtactgggcgaagaagggtgttgtggattttgaaccgatgccacttggcgtgatcgtaacagcgtccggaacaggcagcgagtgcaacgggggagcagttattaccaatgaagaggtcatgatcaagacagaccgggattatccgaaatgcaatccggaatttgcattaatggatccgacttacacttatactgttccgacaaaacagatggtggcaggaagctttgatatcctgtctcacgttatggagacttatttcagtgagccggacgaggataacgtatcagatgatatttcggaagctctgatgcgcggcgtgataacaagtcttcgtgcggcattggtaaatccggaggattatacagcaagaagtaatctgatgtggctgtctaccatggcggagaaccggatcatcaagctcggcaaaaaatgtgattttgaatgccatcagatggagcatcagatcagtgcttataccaactgcagtcatggatgtggacttgctgtgctgcatccggtttattatcggcatatctgtcaggcaggcgcaaagaaatttacccggtttgcggaaaatgtatggagaattccgagaaatggacgtaccgatgaagagatggctgaagctggcgtagaggcattggctgattttatcagagagatcggacttccgacaacacttcgggaagtaggcgtggagaaaaaagaggatctgaaagaaattgcggattcttgttatctggtggatggaagttataagaagatgacacatgaggagattctggaaatatttctggagtgtttctaaggacaatagctaaaaggtgatattaattcattggggcttcagaagccgtgctatgtggatgaacagacgcactaccgctattatgacatcaagtagaatgcctgtttggacatgattcagtatatgaaagagcttggaatggaactgaaagagattaaagagatccctgtgccggaaagggtacagggatctcttgtttcaggtagtaaaatttctatactggatggatctcttggttaaggtgatctgaagtgttttgaggatttgtttcttccgagtgttcattcaccggaagatattcatacttcggaatgaaatcccgtttatcgtacagtttataatactgaatgaaaatacggtccataacttttggaatctgactttcatctgattcaaataaaatgatcagatactgcatggcactataccgtgtacacacgtcaatcctacggatcttgtgacggatcgcttcctccatgtattccagtgcctgttcaatattttcaatatacatcatagaatccggagcggtttccattgtgaccatgaccaggaaacaatggtatttatgtcgttctccaagttggttgatgtactcataaatcttagaaaattcacggtaattaagattaagtgctccggaatagttttcgctgttgcgaagtgcttttgccacaagggaaagatcttttgctacgctggaaaccgggaatacggtattgtccatctgttgatagaaaaagaaattgtgttttccgttttgcttgacataatagagtgctttatctgctttggaagaacactcgtcaaaggaatctcccttggtacacatgcaaagtccggcagaaatggatgcaacacggatctcaaaatcttttttcttctcagaatcaaagcgggaaaacagagtttccataagctcggatatttcatttttaccggcatccggtacaaaaagaaggaattcatcgccaccaaacctgcagccaaccgaatttccgatatgctcggagaggagagctccaagtgctttcagtgcacggtcgccggctttatgaccgtagatatcatttatctttttcagattatccatatccataaagatcagacagccattgtgttcctgcatcagctgtgcgatcattttctgaccggtatttcgcatagggagtccggtaagaaggtcaaaattttctacttcctcctggctcttcatcgtattcataacattggaaatgaagttgctgatttcaaattccatgccaggaagagctggctcgtcatcaatttccagataagtatctgtgatcgtcagacgattctcatccatcagtctgagaaaaatatctgcgatttccggatcgaactgagttcctctgtttttgcgtatttcttcataaattgtttcttttggaagagaattacggtaaatacggcgggaattcattgcgtcatagctgtcagcaacagcaacgattcgcgcatggatcggaatttcttcaccttttagaccgtccggataaccatggccatcataacgctcatgatgagatcgggcaacttcggttacatgattgatgatcgaaacatttttcaaaatctcagcaccaataaccgtatgttccttaataacagcgtactcttcgtttgtcagtttggatggcttgtttaaaataatatcagggatgccgacttttccgatatcatgcagatgagctgcatgtcggagattgacgatttcagagcgattccaacccatttcctgcgcaatcagtgcagagtattccgcaacacgatgagagtgccctctggtgtattcgtccttggcctcgatggttgtagagagagtctgcatcatctgtaaggaaattttttccatctgccgtttacgtttcaaaagctcttctttttgacgatgcatttcaatggtatgcacattctttattgtacggataatgttaatgaaaagaaggatcaacatgctgccaccaataaaaagaccggaaatcaaaactacaaaatatgtagaaatggattcgatggcgatggcaagcattgcaatgatcaggccaatcagcaccaatatgtttttccggtattctttctttcgcatatccagacagaaagtcaggaaaatcagaaagaaggtgactgcaagaatcacgtgggcgcccggcagagtttcaataaaatcagcagtgccagtcagatgaagaaccagacagatcaaaaagttaccaaatgccgcacagccaaggtaaaagtaaggctttttataacgcccctgctgaatgagatctgcataaaaaagtaccgggatcggaacgagcatgatcatcacaaagcataaagtccccagtgcagatggattcggaactataagctgtctgagcttggattcgccgagcatccatgtagctcccatggtcatgcaccatccaagatattccatatcgaattttctgtcatagacaattccgagtgcgatactgaaaaggatggtaatgataccggcgaacaagataaagaaagcaataatagtctcaagcccgtaagattcaaaaatatattcccagatatcactcttgtctccggaatagatctcattgactacaccggaatagttagaggtattggtagtcagctcaatacggagttcttttcctgcatctgctgctgaagtaggacagaaaacataacagctggcagaatttttcccagtcagtcgatggtctttggttgagtattcagtgcgaagcactccgtcaatatagaaacggatatcctgcagagaggaacgtatagcaagtgaactttgcgtataattttcaggaagtgttgtggtaatgaccatagtttcttttgcaggaacattgtaatgtccggggatggcaatctgttctttgctcccatcggagtgaatccaggtaaaagtaccacgatatgtgatgtcgctggattggattctggcattgtgattgttaattcctgtgaattgtattaccagaaaccagataagtatcaggaacatcagaagatagtaaaatccgatctggattttgcttattttatagttttcttttgtcaaaacagagactccttatctacaattttggtctatttgaagatatttatacgatgtgagtgtcaaaagtgaattttgccacttactgatgtaaccggattgctccattgctacgcaattcccacaatccttaaacatcattatactatttgcggacaatatttgcaattaaagagaagggggaatggtggaaaaagacaggtcatggaagttgagaaataccagaagatagattataattttcataaaatattgataccagggtcaaaaggtcagaaagccgatgcaagcttgcttgcaagaggttttttgacctcttgacccgccaaaaatatgagtaagtagccattttttaaagaaaaataagcggattacgaatgtttttgaggattgcgagagtgcaaagcacgtagcaatctggtatcaaaggggtcaaaataccttttgacccaaacatcaaaatattttgtgtatgaaagggaacgtaaaatggtaaaattaagcacactttgttatattgaacaggatggaaaatatctgatgcttcaccggactgtcaaagaaaatgatatcaataaagacaagtggatcggagtaggcggtcattttgaaaaaggggaaagtccggaggaatgtcttcttcgtgaggtatgggaagagacgggatacacgctgacatcctggagatatcgtgggattgtaacctttgtatatggcgaagatgtagtagaatatatgtcgctttatacggcagatggttttacaggaacgccgattgcgtgtgatgaaggagaactggaatgggtagaaaagtctaagatcggagaactggaattgtgggaaggggatcggatcttttttgaactccttgaaaatgagcagctgtttttctcattaaagcttgtatataacacagatgatgttctggaatatgtagcgttagatggaaaagagatgaaagatttcagaagaagagagtgttaaagtggaatgtcgaatagtgtgaaaaagttacgaaagtaatgttttggcatggaatgttgagtctgctcatttggatagtgtatgatgataaagattctcattaaatgaagggggaaaagagaatgtacagtgagttgacaaagatggaagggaaaaggattgtaatccgcacattcggttattttgatatttttgtggatggggaaacgattcctttttcatgtaagaaagccaaagaactgttggcacttctggttgacaggagaggaggatttgtgacgacgggggatgcaatcagttatttatgggaggatgaatgtacagaaaaaagaacaaaagataaattccgcaaagtggtaaaagaacttcggaaaacgttaaatgcatacggaatcgaaagagtcctgcaccgggtaaatcaggagagccgtatccgcacagagcatgtggagtgtgatctgtatgactacctggaggatgaggaaaaacataaaaagctgttcaaaggagtgtatatgacgaattacagtatggaaacttctaaggcgatgattagggaagcatataagcagggagtgcgttatatgattgcaaccccgcattacagaccggagatgttcgaaccttccatgagcaaggtgataagtgtatatcgcaaaatgcgcacctatgcagtggaaattggaataggccttcgacttggctgtgagtattatagaaatgatcagatgatctatcatctggataataagcttcgcccgacaatgcttggcgggaaatatgttctgacggagttttcaacaaatgatagttttataacaattcgcaattatatttatgaattgatcgtcagaggatatcagccgatcattgcacatgttgaaaggtatttttgctgtcaggaactggaaaagattctggaactgagaacacttggagctaagatccaggtgaatgcagatgccgtactgggatatgaagggcacaagataaaaaaattttgtgctactcttatgaaaaacgatcttgttgattttattgcctctgatgcacataatctgagcactcgtaagatgaatcttggaaaatgtgcgagccatgtggagaaaaaaatgggacaggattatgtagaaaaaatttttgtagagaatccgagacggatatggaagagtagataaagaaagcaggtgttttggtgaaaaaggttaatctttcaattgagaagaagagttatgcaactcgtgaagcagttcgtacgctgcgtaccaatctgcagttttgcggagatgataagcgggttatacttgtaactagttgtgtgcctggagaggggaagacttctgtttccgtttccttggctgagtctattgccgatatgggaaaatcagtgattctggtagatgcggatattcgaaaatcggttatggcatcaagacttggtattaccggtgtggagaaagggctctcccatttcctttccggacagtgtgtgcttgcggatgtgattgtcgctacaaacattccgaagttccacattcttttatcaggtccgcaggctccgaatccgacagaacttctggaatccaagagattttcagggatgctggaatccatgaagaacgtatatgactacattattattgactgtccgccgcttggtgttgttattgatgctgcaattataggacgtctaagtgacggagctattatggttgtggaagcgggaaaaacgaaatatcgtctggcacagaatgtaaaagaccagttggagaactctggtgcttctgttttgggtgttgtgcttaataaagtggaacagaagaatcagaagagatattataataaatactatggttcttataagtatgaaggttattacagaacagatgatgatgaaaaaaatgcataaaagataaaaaaatacttgcaattgttaaaagtttctgttaaaataactattgttgtgagtctgcaagatttgtaagcggacatttcagatcgttaggaggtgcaatcatggctaaatgtgctatttgtgaaaagggtgctcatttcggaaataacgtaagtcactctcatagaagatcatctaagatgtggaaatctaacgtaaaatccgttagagttaaaacggaaaacggcggaacacagaaaatgtacgtatgtacaagctgcctgaaatccggacgcgttgaaagagcttaatctgagcggaatgatgagaaccgaagcttttaagcttcggttttttgcgtatacgatgagacaaatacggaactgtccagatttgtgctcgcacaaaaatctgattggatctgtatttggcgaatgtacgacagtgaactgttaagtgagctgccgtataatcaggcaggtgtcagcatgcctgattatcgggctgcattggttgtaaaagcattggaaatagagtataatattttcaacgtttaaaaatagatttattgatatgaattttgagaattggaggatggcatatgaagggaagtatgagtactgatttaggaatcatcacgatcgatccggaagtgatcgcaaaatatgcaggatctgtagcagttgaatgttttggaattgtcggtatggcagctgtcagcatgaaagatggtctggtaaaacttttgaaaaaagaaagccttacaaagggaatccaggtcggaatctctgatgagaataagattacacttaattttcatgtggtcgtagcttacggagtaagtatttcagcagtaacagacaatctgatcagcaacgtgaagtataaagttgaagaatttacaggtatgagcgtcgataagatcaacatctatatcgaaggcgtccgcgtgatcgactaattaaggaggaacttgttgtggcaacaaagagtatcgatgtagaactgcttgcgaagatgtttcttgcaggcgcacagaatatagaagcaaaaaaggaatatatcaatgaactgaacgtgttccctgtaccggatggtgatacaggaaccaatatgtctatgacaattatggcggcagcgaaagaagtaactgcactggaaggcatggatatggcttctcttgcgaaggcaatttcatccggttctctccgtggtgcaagaggtaactccggtgttattctatcccagctgctccgcggattcacaaaatccatcaagacggaaggcgaaattgatgtacctgcacttgcaagagcagctgtacgtgcaaaagagacagcatataaggctgttatgaagccgaaagaaggtacgattcttaccgttgcaaaaggggtggctgaaaaggctcagacacttgcagaggagacagatgatctggaagaatttctcccgaagctgattgaagaggcagagactgttctggcaaagactccggatatgcttcctgtattaaaggaggcaggtgttgtagattccggcggacagggacttctggaagtactgcgcggggcatatgatgcattcctcggtaaagagattgactacagcgcacttgcaccaactcctcaggctgttaatgcaacaaaggttgaaactgagggtacagtggatatcaaatttggatactgtaccgaatttattattcttctggataaagaatttacagaaaaggatgaaatagaatttaaggcttatctggaatcgattggtgattctatcgtatgtgtagcagatgaagacgttgttaagatacatgttcatacgaacgatccgggacttgcaatccagaaagcacttacttatggacagttatcccgtatgaagattgataatatgcgtgaagagcatcaggaaaagctgatcaaagatgcagaaaagcttgcagcagcccagaaagagaaagaaaaagccaaagagccacgtaaaaaggtcggatttattgctgtttcgatcggagaaggattaaatgaaatcttcaaagaacttggcgtggactacattatcgagggtggtcagaccatgaacccgagtacggaggatatgctgacagcgatcgattatgtaaatgcagactatatttacattcttccgaataataagaatatcgtaatggctgcaaatcaggcgcgtgatttgacagaagacaaggatattatcgtaattccgacaaagaccgttccgcagggaatcacagcagttctgaattacaatacagaagaagatgtggatacaaatgaagagacgatgctggaagcgatcaaatgtgtaaagacaggtcaggtgacttatgctgtccgtgatacccacatcgatgataaagaaatacatgaaggtgatatcatgggaattggtgatgcaggtatccttgcagttggcaagtctgtcgatggtactacaaaggacatgctggcacagctggtaaatgatgattctgaactgatcagtctctattatggagaagaagtttccgaagaagaagcagaaaagctgacagcagagattgaagaattatatccggatatggacgtagatgcacacatgggcggacagccgatttattactatgtgttggcggtagaataggcttatgaatgagcagtcagaaatccgtaacctgaaaggaatcggggcaaaaaccgaggaactgtttcacaagatgggaatttttaccatcggcgatctgctccgttattatcccagaggatatgatgtatatgaagagccggtaagcgtaggagagctggaagaaggaaagatcagcacggtaaaaggcgtgatatacggaagagtacaggttggaggaggaaagcgtatgcagattacgacagcatacgtaaaagatctgactggtactttgaaggtgatctggtttcgtatgccatttctgcgtaatacattgaagcagggaatgccggttatcataagaggacgggtagtttcaaaaaaggatcagctgattatggagcatccagagttattttcaccaccggatagttacgataaaaagtgtggaactcttcagccaatttatccgttaactgccggtatgacgaacaatgcggtagcaaaagcggttaaaggtgcgatggaatatctggatctcgtctctgatgatctaccgaaagatctgcgccttcgatatcatctggctgagtataactatgcgatccgcgggatacattttccactggataaggcagaattctaccatgcaagagagagacttgtatttgaagaatttttagttttcgtgcttgctcttcgcaggacgagggagcgaaatgagcgtgccgaaaatggatttgtgataaaaaggcggtcggaaatcgaccgctttcttgcaaatctgccatatgaactgaccggagcacagaagaaagtctgggaacagatccaggaggagatgtgcggaaagctagtgatgtcacgcctgatccagggggatgttggctctggtaagacaatagtagcgcttctggctcttcttctggcggcactgaacggttatcagggcgcaatgatggctccgacagaagttctggccaagcagcattacgaatcaatcatagagatgctggaaaagtatcagattccggtgaaaaccgagctcttgaccggatcgatgacagcaaaggaaaaaagggaagcttatcagaggattgctgcgggagaagtgcagattgttctgggaacccatgcactgattcaggagaaggtggaataccagaatctggcacttgttgttaccgatgaacagcaccgatttggtgtccgtcagagagaggcacttgccgggaaaggacaaattcctcatattcttgtaatgagtgcgacaccgattcctcgaacactggcaatcattttatatggagatctggatatttcggtgattgatgaacttccggcaaaccgtctgccaatcaagaactgtgtggtggataccagttaccgaccgactgcttaccgctttatgcagaagcaggtcgccgaaggaagacagtgctatgtgatttgtccgatggtagaagagagcgaggcaatggatgcagagaatgttcttgactatgcgcagcttctgcaaagtgagatgggtgacaagatccggatcgctgcgcttcatgggcggatgaaacaggcagaaaaagacgagatcatgggagcatttgcaaagaatgagatccaggtcctggtgtcgacaacagttatcgaggttggtatcaatgtgccgaatgctacggtgatcatggtggagaatgctgagcgttttgggctggcgcagcttcatcagctccgcgggcgcgtaggacgtggcagacaccagtcctattgtatttttatgagtggttcgaagacgaaagagacaaaaaaacgacttgagatcctgaacaaatccaatgatggattttttattgcgaatgaagatctgaagcttcggggaccaggagatctttttggaatccggcaaagcggattaatggatttccggatcggagatgtgttccaggattcggagcttctgaaaaaagcaggagaagcatcgggggaaatcctgagggaagatccactgttagaaggcgaaaaatataaactgcttggtgaaaagcttgcggcatacgtttcgggaaacaatctggaaacgacgttgtagataaaaagatagtgggcgaattgttctgcccactatctttttattcataaaaccagtaaataataaatttgttaagggatgcttcttcactgtatgaataagaaacctgccaaagtccatatagctcacccaggtatcctgcaccttcttccatgagggtttcatgcatttcatccacgacctcctgatagactgcatcatctgacattttaaatatcgtataagcctcctggctctcaatcgatctgtcgatcacttctcgcagcataccaggttcataggtatcataatacatgccgttcatttgataatagttcagattttcagactgacatgacggatatacatagtccgtgctgatcatatgtgttttttctagctctttttcgctgcagcagagataatcgtaagcaatcaggttcggtatctgatagccattatcttcgccgagaaaaatcggatctccccaggttgcatctacataataatattgaccattgcactgaacaatattccatgcatggtctgcgatgcctccatttggatctgtagcccgtccggttacatagatacagtaaatacccagttgttgcagcagatactggcagctttttgcatagccggcacaaaccgatctttttccgacaagagcactgtaaatattctggttatccggtgcatcaagatcataatctacgttatctatgagataggtgtaaatgtattttatcttttcgtattcatctgaaaggtctgaaatgccagaaagacaggtggctcttgccgattcaatctcctgattccgttgttctttttcttctccctcataaagataattgggttctattactacatatcggctctggccttcagaatgagaatattctgtggaagttgcatttccatcacaccagaaaatttccggtctgtcatttaacacattctgaaatacttcatttgcagtattcgcgttgctgcaatgcagataaatttcttttttattttcctggataccctgaagaatttctcggtaaaccgtttgctcttcatcagaaagctgttcatagtagaattctccggtaacctctgcatccgtaattttttcctgttcataaggaacttcttccggcgcggaactctctgctttcggagtggctgacatttgtctgccgatcaggattcctccggatataagacagagacagccaagtcccaaaagaatgaacggaaaaaatttccctgtttgatgcatcttttttcgcataatctatttaattcctccaaatactcatctgtatgtttcatcataacatacccttcatttttgcacaacacggacattttttacatataatgtttctgacagtataaaaagccttgaggatatcagatatgagatttttgaaagccatgcagacttctgatcggggaaatttgcagatacagattacttcgtctattgattcttttcctgtcccagatgcgtcaatccgtatttcctatacaggtattcctgaaaacacactggaagaactgacaaccgatagctccggacaaagtgaaaccattgagcttgacgcaccgcctgtggagtatagcctggatgcaacaaatgaagaacagccatatgcggaatataccctggaagtaaacgctccgggattcgagccggtcaacatcgcaggaacggaaatactggccggtgtgacggcaattcagaagattcgtctgcgtccacttgtcacggaagaccagaccccggaaatctttgtgattcctgcacatactctgtacggtgtgtatccgccgaaaatcccggaaaacgagatcaagccggtaaacgaaaccggtgagattgtgctaagcagagttgtcgtgccggaatacattgttgttcataatggctcaccacgcgattctaccgcacagaattattatgtaaaatataaagattatatcaaaaatgttgcttccagtgaaatctatgcaacatggccggaaaatacgatccgggcaaatgtactggcaatcatgtcttttacgctgaaccgggtttataccgaatggtatcgcaatcagggctatgatttcacaattacatcttctacggcttttgatcacaaatggattccggaacgaaatgtttttgactccatttctacagtggtggacgaactgtttgcagattatctttccagaccgaatgtaaggcagccgattctgacacaatactgtgacggaagacaggttcagtgtccgaactggatgacccaatggggttctaaagcacttggtgatcaggggtattctccgtcggaaatcctccgctattattacggagatgatatatacatcaataccgctgaagaaatttcaggcattccgtcttcatggccagggtataccctttcccagggctcttctggcacaaaagtccggcaaatgcaggaacagctaaatgttattgctggtgcatacccggcaattccgaaaatcacagttgacggtatttatggtccggcaacagcatcgtccgtcagaaaattccagtcggtgttcgggcttccggtaaccggaactgttgattaccgtacatggtataaaatttccgaaatttatgtaggtgtatccagaattgcagaattgtcctgacttggattttatattatgatctaagttttctcccaaagtctgcttttatgcaaggaataccaaatgtgtcatgcttcagtttaaaatgtttcatactcatctggtgcagattactgcaaaataaaaaatgctaaaattaacaaaacctcccagtgtaatctgaatttattctccatatactaggagcgtaacacaaaacaaaatgttacaaaaaaggaggaaatgaatatggcaagtcgttcatcaaacagagcagccgtgccagaagcaaaaggtgcactggacaaatttaaatacgaggttgcaagcgaactgggagtaccgttatcagacgggtacaacggagacttaacttcaagacagaacggatctgtcggaggttatatggtcaagaaaatgatcgaagaacaggaaaaacagatgtccggtcgataggacagtcagtgaaggtatcacaggcatttctgccggatacaaaaagggaatgtctgataaacaggcactccctttttctctgatcactaagctggaaatcggacttgaaccgacgaccccttcattacgagtgaagtgctctaccgactgagctattccagcattcgtactgctttcgcagtcacgaattatattatatcaaatttttgaataaaagcaactcttttttaaaaaaattacactttaaaataaacataaaaaataggtattgaaatctgtaaccagatatggtaaactttttacaatttgagaaagtgtgggcgctctggaattgaaaagactccaagagtgccccttttttgagaataaaagagtattacgaagggataaggtgaacatatgaaagcgtttctaattttagaagacggaactgtgtttgaaggcacaagcatcggctcaacaaaagatatgattagtgagattgtattcaatacttcaatgactggatacttagaggtgctgacagacccttcttacgccggacaggccgttgtcatgacatatccgctgatcggaaactatggtattacaccggatatggagtccaagaaggcgtggccggatggttatattgtaagagaattgtccagaatgccaagcaacttccgttgtgaaggtacaattcaggatttcctgaaagaacaggatattccgggaattgcaggaattgataccagagcacttaccaaaatcctccgcgaaaagggtacaatgaatggtatgatcacaacgaatgaaaattacaatctggacgaggtacttccgaaacttcatgcatacaaagtaggagatgtagtttccaaagtaacttgcagtgaaaaatatgtcttagaaggcaatggaccaaaagttgcattgatggactttggtgctaagaacaacattgcaaggtctttaaatgatcgtggatgtgaagttaccgtttacccggcaaatacacctgcagaagagatcatttccgcaaatccggacggtatcatgctgtcgaacggacctggcgatccggcggattgcacttccattattaaagaaatcagaaaattatacgattcagagatcccaatctttgcaatctgtctgggacatcagctgatggcactcgccaacggtggtaagacctataagttgaaatacggacacaggggcggaaaccatccggtaaaagatctgcagacaggaagagtttatatttcttcccagaaccatggttatgctgtagatgctgatagcattccggaaagcgttgcagtacctgcatttgtgaacgtaaatgacaatacaaacgaaggaatgtcatacgttggaaagaatattttcacagtacagttccatccggaagcttgcccgggaccacaggattctggttacttgtttgacagatttatggatatgatgggaggaacaaaataatgccaagaaataaagacataaagaaagtattagttattggttccggtccaatcgtaatcggacaggcagcagaatttgactatgccggaacacaggcatgccgttcactgaaggaagaaggacttgaagttgtacttctgaattcgaaccctgcaacgattatgacagacaaagatattgcagaccgcgtttatatcgaaccacttacggtagaagttgtagaacagctgatccttaaagaaaaaccggacagcgtacttcctacccttggaggccaggccggactgaaccttgcaatggagctggaagaagcaggattccttaaggaacataatgtgagactgatcggtacaacggcggaaaccatcaagaaagcagaagaccgtctggaatttaaagataccatggaaaagatcggtgagccggttgcagcttcactggtcgttgaaaatatagaagatggtgtcgcgtttgcagataagatcggatatcctgttgttcttcgtccggcatataccctcggcggaagcggtggtggtatcgcacatgatcaggaacaattggaagaaatccttgagaacggactccgtctgtcacgtgtaggacaggttcttgtagaacgctgcattgcaggatggaaagaaatcgagtacgaagtaatgcgagacagtgctggaaactgtattactgtatgtaatatggaaaatattgatccggtcggagttcataccggtgacagtatcgttgttgcaccttcccagactcttggagataaagaatatcagatgctgcgtacttcggcactgaatatcattacagaactgaatattactggtggatgtaacgtacaatacgcattacatccagactcttttgaatattgtgtaattgaggtaaacccgcgtgtaagccgttcttctgcactggcttccaaagcgacaggatacccgatcgcaaaagttgctgcaaagattgcccttggatatacactggacgagatcaagaatgcagttacaaagaaaacttatgcaagcttcgagccaatgcttgactactgtgttgttaagatgccgagacttccgttcgataaatttatcagtgcaaagagaacgttgacgacacagatgaaagctaccggagaagttatgagtatttgcgataactttgaaggagctcttatgaaagcaatccgttctctggagcagcatgtagactgcctgctttcttatgatttctcagcactttccaaagaagaaattctggaaaaactggaaatcgtagatgaccgcagaatctggatgatcgcagaagcactccgcaaaggaatctcttatgacgagatccatgcgatcacaaagatcgacaaatggttcatcgacaagatcgcaatccttgttgagatggaacaggctctgaagacacaggaactcacaccggaacttctgaaagaagcaaaacgtattgaattcccggataatgttattgcacgactgaccggaaatgatgagagagaaatccacgatatgcgtcatgcgaacggaatcgttgcagcatacaagatggttgatacctgtgcggctgagttcgcggcagagactccatattattattctgtattcggaagccagaacgaagtagaagagacttccggcaaaaagaaagttctagtacttggatcaggaccgatccgtatcggacagggtatcgagttcgacttctgttctgtacattgtacatgggcatttgcaaaagaaggatacgagactattatcgtaaataacaacccggaaactgtaagtaccgatttcgatatcgcagataagctgtatttcgaaccacttactccggaagatgtagagagcattgtagacctggaaaaaccggacggagcagttgttcagtttggtggacagactgcgatcaaattaacagaatccctgatgaagatgggagtgccgattcttggaacttccgcagaagatgtagatgccgcagaggacagagagctctttgacgagatccttgcacagtgcaatattccacgtccgaagggagatacagtatttaccgctgaagaagcaaaagaggttgccaaccgtctcggatatccggtactggttcgtccttcttatgtacttggcggacagggaatgcagattgcaatcaacgatcatgatattgatgaatttatcggaatcatcaaccgtattgcacaggatcacccgattctggttgataaatatctggtcggtaaagaaattgaggtcgatgcagtatgtgacggaacagacattctgattcctggtattatggaacatattgagcgtgccggaatccattctggtgacagtatttctgtatatcctgcgcagagcatttccgaagtgacaaagcgtaaaattgaagaatatacaaagcgtcttgcaaaagcccttcacgtaattggtatgatcaacatccagttcatcgtatgtggcgaagatgtttatgtcatcgaagtaaacccacgttcaagtcgtaccgttccttatatcagtaaggtaacaggtatcccgatcgttccgcttgctacaagagcgatcatcggacataagatcagagaaatgggttacacaccgggacttcagaaagaagctgattatattgcaatcaagatgccggtattctcatttgagaagatccgtggtgcagatatcagccttggaccggaaatgaaatctacaggtgagtgtctgggaattgcaactacatttaacgaggcactttacaaagcgttccttggagctggaatcaaccttccaaaatataagaacatgatcatgactgttcgtgatgaggataagggagaggctgttgagatcggacgcagatttgaggcacttggctaccgcatctttgcaacacgcggtacagctgatgcattaaaagaaggcggcgtaaaagcaattccggtcaataagattgagcaggaatcaccgaatctgatggatctgattcttggacacgagatcgaccttgtaattgatactcctccgcagggagcagatcatgcacgagatggatttgtaatccgtcgtaatgcaatcgagacaggtgtcaatgtactgacagctatggatacggcaagagcacttgtgacaagtctggaaaatacagatatccgtcagcttacactgattgatattgcgaaagttgaataagatgttatgaatgcggacaggcagggattggattctctgcctgtttgtgttatggaaaatgcagggacgagacggacgctacagtggcaaaagaatgtgaatctgtgtagagaatttcggatattggctggaattgtggggaaggagttttatagtgtgaaaactattgtatgtgtggataaccggatggggatatgctttaatggcaggagagtgagccgggaccggatggtgtcagaggatattcttgagatgacgagagggaatgtgctctggatggcgccggaggcagataagctttttaaagaggtctttaaagcaaaagaagaggtatgccgggaaactgggactgggaagaaaatacaggacgcagggcgactggaggatgaaaaaatgtggaaggttgaccggaattttctggaaaaggcagaagaagaggatttctgttttgttgagggggagaatctggctggatatgaggggaagattacagagattgttctgtataaatggaaccgggattatccggcagatgtattttttgaggtagatttaagcaaatggagactggaagagagaaaagatttttccggttactcccatgagaagattacaaaagaaatttacaacaggcagggattgctatgaagaagaaaattgggaaaatgagaggtgtgctgcttctgacgtttgcattgtttctgacagcgtgtggtacaggtggagcagatgcgcaaagtgcatcatatggaaacagtcaggcagcagtagttgaaaaacagtcaggtagcggagaaaatgaatcggcagcaggtggcagccaggagccggtgagcgctacattggataatattccggtatacagcggaataccgtatgtagtgattgacgataatgaaccggattttaccgaagatgagctgacagattagtcttatgaaagctacagtgatctggatgagctggggcggtgcggtgttgccacgtccagtattgggacagatctgatgccgaccgggaaaaggggaaagattggacaggtgaaaccgtccgggtggcagacaataaaatttgacaatgtggatggaaaatatctttacaaccgttgtcatctgataggctatcagttgacggcagaaaatgcaaacgaaaagaatctgattacaggaacccgctatatgaatgtggatgggatgctgccatttgaaaatatggttgccgactacatcaaagagacagataatcatgtaatgtatcgtgtcacaccggtatttgaaggggagaatctggttgcatccggagttttaatggaagcagaatccgtggaggatcatggagaaggtgtgaaatttaatgtgtatgtctataatgtacagccgggaattacgattgattatgcaacgggaaaggcagtgctttccgatgaggatgcgtcagcgggtacgggaaaaaccagtggaaatacagagaaaaagacgtatgtgttgaatgaaaatacaaagaagttccatacgtcggagtgctcaggagtaaaagatatcaaagaaggaaataaaaaaacatttacaggttcaagagaagaactgattaaagaggggtatagcccgtgtgggagatgtaaaccgtaagaggaaaataaaagaaaaactgcatattctgcgaaaaatataaaacaaacgggagatttttaaacaaaatctcccgttttctgctataatagaaaacatacttaatgaatatacattagaggaaatgtgtaaaagaaaaaggaggaactttctcatgaatacttatcatatgggaacaaaatgcgtgcagggaggatatacacctggaaatggagagccgagacaggttccgatcattcagtctacgacattcaaatacaatacaagtgaagatatgggaaaattatttgatctggaagcatccggatatttctacacccgtctgcagaatccgactaacgaccacgtagcggcaaaaatcgcggcgatggaaggcggaacagctgcaatgttgacttcttccggacaggcagcgaatttctttgctatgttcaatatctgtgaagcaggagatcatattgtggcttcctcttcgatttatggtggaaccttcaatctgatcagtgtgacaatgaagaaaatgggaattgacgcaacatttgtttctccggatgcaacagaagaagaattaaatgcggcattccagccaaatacaaagctgatgtttggtgagacgattgccaatccggcacttactgttctggatattgagctttttgcaaaggttgcacatgcgcatggtgtaccgctgatcgtggataataccttcccgacaccggtcaactgtcatccgatcgaatggggagcagatattgtgacacattcgactacaaaatatatggatggacatggagcagcagtcggtggagcaatcgtagacagtggtaaatttgactggatggctcatgcagataaatatcccggactttgcacaccggatgaaagctatcatggaattacctatgctgagaaattcggaaaagaaggcgcatttatcacaaaatgtacttctcagttgatgcgtgatctcggatcgatccaggcaccacagaatgcatttatcctgaatctcggactggaatctcttcatgtgcgtatgccaagacacgtggagaacggacaggctgtcgcagaatttctggagcagcacccaaaggttgcttatgtcaattatccgggacttccatctaacaaatactatgaaagagcaaagaaatacatgccagacgggggctgtggagtggtatctttcggattgaaaggtggaagagaagctgcttccgtattcatgcagaatctgaagcttggagcgattgaaacccatgtggcagatgcgagaacctgttgcctgaacccggcaacatccacacatcgccagatgaatgatgagcagttaaaagaagcaggagttccggcagaactgattcgtatcagtctgggacttgaagataaagaggatctgattgcagatatttctgcggcacttgacgcaattcaataatcgtgtcacaatgacagataaagaaatctgatcagacaggaggaaaagagtcatgacaaagaaatcagaaagacaaccaatcaaagcagaaaatgtagcgggtggcgcaggctatatcctgaaggaagaactgatcaaaggtgaacagctcggcgcgtactgcaagatgttcaatgaagtaacgttaaaacctggatgtgagatcggatatcatgagcatcatggagagactgagacttactatctgacaaaaggggcaggcatttacaatgataatggcaaagaatatccggtagaagttggtgatgtgactttctgcgcagacggaaatggacatggcatcaagaatgcgggggaagaagatcttgtgtttgtggcgcttattttgaaagaatagtgtgaagagggacggatttcggcgcaattgatattgatcgtcacctatgaaactgtcactggcagtttcatacggatgcatggcaactccgaagcttgtacaaaaaaggggatgatgttcgtgtgaacacggacaccacccctatttttgtgcgctcttagtcgcaacgattcaatatcatttgcgccgggatcctgtgctgctcaaaatttttagaaataagagttggcgatttagtgaatggtcttcttgtggggataggaaacattatgcaaagaaatcctgtattccttgaagcagtctcttattatcttccggagccataatgcagaaccggaagtattccccgcccagttctttgaagctggagcagtctctcaccatcagaccctgcttgatcagaaattcaaacacatccgcagaagtaactccctttttttcaatctttaccagtacaaaattcgcataagcaggatacacagtcagcacattgattttggagatttcagtgcacattttgtctcgttcagagatgatcagatctcgtgttttccggatatactcctgatcctggagcatcttctcaccagcgtaagcgccgaggctgttcagactccatgggttctgcatcagcagaagatcctgaagaaactggctgttactggttgcaccgtagccgaggcggagaccaggtgcggcataaaatttggatacgccacggagaatcatcagattatcaaaactgctgatcagagacatggaagaaatttcattaatatccggtgcaaattcaacgtaagtctcatcgatcatcaagaaagagccagcctcccggcagcagtccagaatggtctggatctcaggcattttgagagcggacgaagtcggattgttcgggttacataatatcaccagatcatagcctttcctgatttcttcgcagaaggcatggatatcaagatggaactgatctgactcttttaacaggtaagtatggatggaacttcccaccagatccagttcacgtccatactcggaataagttggtccaagaaccagtgttttttgtggtttccgtgtctggatcaggagagagatcagctcggtagaaccatttccgacgattacatgttccggtaaaatctggcagtaatcggcaatcactttcttcaaagtagtgtaatttcggtccggataactactgagaagatccagatgtgcagcaagatcttttttcaggtttttggataatccaagtgggttgacattggctccaaagcagacaatctcgtccaccggtacatgataaaatgcggcgacagcagcggtgtcacttccatgaaactgcggttttgcttccataaatagtattctcctttgtgtataacaaaaatctgtgaattaaaaaaatcgggtattccgcattgcctgatatgcagaataatgttataatttattataatgtctttttgaaaaaatgcaatgcagaagtaggtggcaagcttgaagaataaaataaaaaaattttccaaaggagattttcgaactgttcatccggagattgtactgccggtaacgaatcttgagatgacgatcggggaaggagagtcctgccagggaagtttcattttgaagaacaggaaagaaggagatatcagaggacttgtatattcttcttcttttcgtatacatttagaagaacagggatttgagggcaacccggtggaactccgttttacttatgatggaagcggacttgctcccgggcatgttgaacagggaaagtttacgattgtatgtaatggtggagaatttgaggtaaactttactgcgatcattgaaaaaccatcagtcgagacttcctgtggaagagtacagaatatccgtgattttaaaaggctggcgatggagaactttattgaggcacaccgtcttttcagatcacgcgatttttatgacgtgataaagtatgaagagccaaggataaaggcactttatgataatattaggaaatggtctctcggtgagcaggcgatggaagaatttctggtcggaatcaaacagaaagaatgtattttcctgacaatgggacggaatcagagaaccttccgcaatttaaaagaagcaacccgtgagattattcattttacaaagaatacttggggatttatgccggtgaaggtgcatgtgagcggtgattttatccagattggaagggataactttacaacggacgattttgtgggaaatctgtttgatttcagttatatcattcatccggaaaaggctcatgcgggaaataattatggacagattgtttttgaaagtccgtatgaatcgctgacctatgaggtaatgttggccaatcacaaggatcatgcagagaacagacgtgtggcagataagacgattgcatcaatcataaaggatttccttgcgtgcaatgcggaaggaaagaatctgacagcctgggcggacgcaacaagagaaaaactgaaggaattggatatatattcagaagacggagatgtttatccactgtttgatgcacatcttaacctgctctgtaaggagccggacaaggccagtggtattctggatgattacaattacagccgtttctcagtgaataaggattcggtcatttcatcgtattatctgtatctgactgcgcttttgagaaaatcaggcagccaggttaacaaagcaattgaagaactgaataaggcatatatgaaagaaccaacttcatgggagcttgtgtgtatgctgattgacattgatccggaatataaaaactacagcaaaaaattacaggttctggaacgccactgcagcaacggtgcgaaccaggtaattctgtactggcaggcataccggtgttttctggagaagccaacctgtctgaaaaagctctcggcatttgaagtacagattctcaattttgcgcagaagcacggagttctgacaaaggaaattgcgctttatatggcgaaccttgcatcccaacagcggacttatgataagaatctggatgttgtgatgcagaaggtttatcggattttcccggatccacagattctgacagcaatttgtacccatctgatccgtggcaatcggacaacaccagaatgcttcaagtggtatgccttggcagtaaaagaagatctgaagattgcgcagctttttgaatattatatgatgactgtggatgacaaatatctggacagacagtttccaaaatccgtattactttacttccggcatggaaatacactggaatataaaaaagcagcggtgttgtatgcaaatctgattaactgtgaggaagaaagcagtgagctttacagtgcttacagagagcagatggagcggtttgcctggatgcagcttgagaatcgaaggatcaatgatattctgcatattatttacaaacgctgctgtactgagcgggatatgacaccggaaagaatacgggcagtttatgatatctgccatgcttatgagattaagacaacggtaaagaacatggcgtttgtcatggtgatcgagcctgacggaacgatcagtcagaaagtacagtacagtgcggatggagtgattgtatatttatacaataaagacgcacggattgtctgggaatcaaaagacggccgccattacattgattccattccatatgagactatgaggatgttctatgagaaccggtatatggaaatctgcaaaaaatatcaggaagagcatgaggaagaggagcggaagaaagagaaaaaagaactgacctgggatatgcttagagagcacgggctggagatggcagatgaaaaagaagtgtttaaaatgtgcagtatgcgcctgcgtgaagaaggtacggaggaggatgattttcttctggcattatgctttgaactgtttctgaaagatcagtatgataagcagacgctgtcttatcttgctgagtattattgtggatcgacccgtaatatgaagaaactctggcatgtggcaagagattatgatattacaacctacaagctttcagaaagaatcattacgcagatgcttttctcggaaactatgtttggtgaggaagaaatttttgcggattattatgaaggaagaacgtatttccgtttaaagagagcatatcttgcttatgtttcaagagaatatgtggtgaacggacgccaggtaaaaggatgtatttttgtaatcatcgcaaatgaataccgcaaagaggaagatcttccggatatctgtaagatcgccctgctaaaatattattccagcagggaagtgcatcaggaactggaaccgatgctacgggaattcctgcgcgaaatgtgtgaaaaacagctgtatttttctttctatttgaagtatccggagaactggctcagagaagtgcagctttatgataagacgatgatcgaatatcacgcaaaacctggaagcaaagtggcaatttcctaccagatacggaaaggcgaaagtgataatatgaattatcaggaagaaatactgcttccggcatatgaagacacttatatcaagagctttattttgtttggtgatgaatctttgcgttattattttacagagacgaataaggataaggtgacggttacggaaaaaagtgactataagccgcgtgaggtgagaccaatcggaaaatttggaagactgaatgatatgacatcactgaagaatgaagcactggcaatcgcgatgaaggaatttgcaacagaaaaacagcttgctgaggatatttttgttgcttactaaaggaggaaatacttcatgacacatggaagtattataggatatgacatcaatgcaaagatgtgtcagatcagttattataatgaaaaaacacaggaaccggagacggtggataccggaattgaaaaagagaacaatcagattcctatggtgatgaactattataaagagacctggacttacggaagacaggcaagaaggatgtctacggtaagggacagtatctgcgtggaagggatctgggagtgtgcgcttggcaataggaaaattgaggtagacggacaggaatatgaaggcgttcagctgctggcggattttgtaaagtacacgttgaacggatttgaagaaattgaaagcatcacgtttacagtcccggagaaaaacgaagacatccgcgtcttgctgaagggaatcggacagaaactcggagtggcaaaggaaaatatttatgttcaggactacaaggaaagtttctgtcattatatgtttaaccagccgaaagaattatggcagtatgaagcggcacttttttactgtgacgaggatgtgatccgggcatatatgttgcgggaactgaagaacagttcgcagaaaagcagagaaagctttgtgacggtggacaaggtggcagatgcacgtatggaagaactggaagcagtttatccggtgctgcatgttgagaaggcaaaagcggcagatgagcattttaaacgttttatccagagtgtattcaacaagaagatgatctcttctgtctttttgacaggagatggatttgaaaataactggtatccgaattctctgcgcgttctctgtaacggacgccgtgcgtttatgggaaataatctgtacagtaaaggagcgtgttatacagcgcagcgtagaaaagaggaacagtcaaatgcgccagtctacctggatgagacaaaactgaccgagcagatttccgtgcggatgcgcgtgaatggagaagaaggctggtacccactggtatcctggggcaatcactggtacgaatcagacagacagttcgaggtgcttcttggtgatacagaggatattgagatccatgtagattctctggtgaccggcaggcatcttgtggagtcggtttctctgaaaggtttgccggaccggaaaaactatgcgcttcgtctgaaaattagtacattcttctcggatgaaaagacctgtcatattatttttgaagatatgggatttggcgaattttttgcgccatcaggattccggttggagaagatcattgaattaggaggcagcaatgggcagtttaattctttgtcataagaaaaaggcaaaacatccctatgaaatttcgaggatccatacaaggatcagtacactggaagagctgtgttattatctgtgcaacaatctgtatctgatcgattatacgatcatgaatgagcagctctgcagatggatcgcagatgaactggaaatgcaggatcttgcagtaaagctggtggaactgatccggaatcatggctccgtggagaaatttgtggttcttgtgttacatgaatccagaatctacacaccgggtgaaatggcacacatccagaatgttctggagaaactcaagaaccagaaagaagtagaacgtcagaaatacaaagcagataagctgatggaaagtggagaactggaatcggcaatcctggtttacatgtcgatcgtcaacggagaaaaggatgattcagtagataagcgtttttatggtcgcgtgtctgcgtgtcttgccggagcatatgggagagcatttctgtatgaagagtcggcgagaatgtatgagaaggcgtataagatctgtgaagataataaaatgctcgaaggttacctgtatgcaagttccagatacatgccgcaggatgaatatcagaagatggtcatgggcaatgaaatccttttggaaattgacaacaaacttacagaaaagatagaaaaagtgagagaaaatatcaacatcgaaccgtcaaaggaattgtttgaagaatggaaaaaagagtacagaagagcatagtgtacgggagaaagttcaaggctgtgtattgattttcggaaaatcatgtattatactctctatgtaaaaattaagcggatacaacaaataggagaagacaaaacgatgagcgaacttgaaagagtagagactggtttaggtgaagaatgtggtgtattcggtgcctatgatatggatggtggcgatgttgcgccgtcagtgtactatggtttgtttgcccttcagcacagagggcaggaaagctgcggaattgcagtgacagatacctatggcaagcggaaagttcatttcagaaagggactaggacttgtcaatgaagtattcgatgaggaagaacttggcaaattaaagggaaaccttggcgtcggacatgtgcggtattcgacagcagggggaactcgtgcggaaaatgcacagccactggttctgaattatgtgaaaggtacattggtgattgcccataatggtaatctgacgaatgcgatcgagcttcgtcatgaactggaatataccggagcaatcttccagacaacgattgattcggaagtgattgcctatcatattgcaagagagcgtctgaaggtttcaaaggcagaggatgcggtcaggaatgcaatgaagaaaattgaaggcgcatatgcactggttgtatcaagcccgcgtaagatgatcggagcgagagatccatttggtctcaaaccactctgtatcggcaagcgagataatacctggttcctggcatcggaaagctgtgcccttgcagcagttggtgcagactttatccgtgacgtggaaccgggagagattgtcagctttacaaagcatggagtatcttcggacaaaagtatgcagattccacctgaaaagcaggcacgttgtatttttgagtacatttattttgcacgtatggacagcgtgatcgacaacatcaatgtatatcatgcaaggattgttgcaggaaaggctcttgcacagtcttatccggtagaggctgatctggttgtcggtgtgccggattccggactggttgcggcaaaaggatattcggaatattccggaatcccttacggtatggcattccacaagaacagttatgtaggaagaacctttatcaagccgaaacagagtcagagagagtccagtgtgaagatcaaactgaatgttattgaagaggttgtacggggcaagcgtattgttatggtagatgattccatcgtccgtggaacgacctgtgcaaatatcatcaagatgctcaaaaaagcaggagcaaaagaagttcatgtaagaatcagttcgccaccgtttttacatccttgttattttggtacagatgtaccgtcgaatgatcagctcattgctcattcacatacaacggagcagatccgtgaaatgatcggagcagattctcttggatatatggaaatagataagctgaaagacatggttggagatcttggatactgcgatgcatgttttacaggaaattacccgatgcgcgttccgggaaaagatatttcccacgcgtttgagtcagaagaatagggaggataagactatgggatacgacaagtatgtaagtccgctttcagagcggtatgccagcaaggagatgcagtatattttttctccggacatgaaatttaagacatggagaaaactctggatcgcacttgcagagacagaaaaagagctggggctcaatattacagatgaacagatcgcagaactgaaagagcatgcagaggatatcaattacgatgtcgcaaaagcacgtgaaaaagtagtgcgccatgatgtgatgtctcatgtatatgcatatggacagcagtgcccgaaagcaaaagggatcattcatctgggagcaacttcctgttatgtaggtgataatactgatatcattatcatggcagaggctctgaaacttgttaagaaaaagctggttaatgttctggatgaactttcaaagttcgcagatcagtataaagatcttccgacacttgcatttactcatttccagccagcacaaccgacaacggttggaaagagagcaactctgtggatgcaggaattttctatggatcttgcggatcttgattatgtgcttggaagcctgaaacttcttggatcaaaaggaacaaccggtacacaggcaagcttcctggaactgtttgagggagatcaggagaccattgataagatcgatccaatgattgctaagaagatgggatttgaagcatgctatccggtatccggacagacctattcccgtaaagtggatacaagagttgtgaatgttcttgccggaattgcagcaagtgcacacaaattctccaatgacatccgtcttctccagcatctgaaagaagtggaagagccgtttgaaaagacgcagatcggatcttctgcaatggcatataagagaaatccaatgagaagcgaacgaatcgcatctctgtcccgttacgtgatgattgatgcgctgaacccggcgattacttctgctacacagtggtttgaacgtactctggatgactctgcgaacaagcgtctgagtgtaccggaaggttttcttgcgattgacggtattctggatctgtgcctgaatgtcgttgacggactggttgtatatccaaaagtaattgaaaaacgcctgatgtctgaacttccgttcatggcaacagagaatattatgatggatgcagtaaaagctggtggagaccgtcaggaactgcatgaaagaatccgtgaactttcgatggaagcaggaaagaatgttaaagaaaaaggtctggacaacaaccttcttgaactgatcgcgtcagatgatgcatttaatctgagtctggaagatcttcagaaaacaatggatccatccaaatatgtaggacgttctaaagaacaggtcgaagcattccttaagaatgtgatccggccgatcctggatgaaaataaagagctgcttggtgtaaaagcagagatcaatgtatagaataactgaataaacagaatgaaagagcaggaagcagatttccgggtaagacggaagattgtttcctgctttttatttatgtttcatggtctgaaaataacttctttgaaatatcaatatagtaaagaattaatgcgttcatctgaaagaatctataaatcccatggaaatgcatagatattaaatcgtcattaattagacaatttgacgaaaaatatgaaaactgagtttttgacaaacacagaaaagcgcgaaaaaacgcacttatttagagcaaatttattatgttatcacaataacatggtgataatacacaaaaaataaataaattaactgaaaatattgcataaaaactataaataggttattatagattcaacagataaaaactataagggatgtctattaaaaaggagggttaccgtatgagtatgaacgatttagtattaaaggtaaatgatgtcctaacaggatcggtgctgatcatagcacttgtaggtattggcttgctgttcacatttaagcttggatttatccagatccgtggttttaaagatggatggaacagaacttttggcggactttttagtaagaaaggggatgccggaaaagacggaatgtcttctttccaggcacttgcaacagcgatcgccgctcaggttggtaccggtaatatcgccggagctgcaactgcaattgcagtcggtggtccgggagcaatcttctggatgtggatcagtgcattcctcggaatgtcaacgatcttcgcagaagcggttatggctcagaagttcaaacaggtcagtgatgacggaaccgtaactggtggtccggtatattacatacgaggagcatttaaaggaacgttcggaaaagttctggcagctatttttgcagtgctgatcatctttgcacttggattcatgggcaatgcagttcagtctaactcaatcgcagcatcatggaacactgcattcggaattccgaagattgcaatgggtatttttatagcagttgtttctttgtttgtattcacaggtggtatgaagcgaatcgcaaaagttactgaactgatcgtgccgatcatggcagcattttatatagtaggttctttgatcgtaatttttgcaaacgttacagcaatcccggcagcattccatgacattattgtcggtgcgtttaaaccggcagcagtagcaggtggtgcaatgggcgcaaccttgaagcttgcagtacagaaaggtgtggcaagaggtctcttctccaatgaagctggtatgggttctacaccacacgcacatgcagtagcaaaagtaaaccatccggttgaacagggctttgtagctatgatcggtgtgttcattgatacattcgtaattcttaacctgacagcacttgttattatcacaacaggatcaagaacaactggttttacaggtgcacagctgagccagtatgctttctctactttatatggtaagttcggtgagatctttatcgcgatctgtatgttgttcttcgcattctcaacgatcatcggatggtatttcttcggtgaagcaaacatccgttacctgtttggagcaaaagctgttaaaatttactcaatcattgtatgtatctgcgtagtacttggatcacttcaggaagtagaccttgtatggaatatggcagactgctttaacagtatgatggttatcccgaatgcgattgcactggtagcactcagtggccttgttaagaagacacatgacgattactataataatttcctgccaaatcagaaaaaaggaaaatagataatttgtataatagccggaaaacagttatagaaaaaaacaataagaaatatacaaaaaaatctataaaaagactagcattttgtataaatgtgtgctatagtaatcatgtcagcaagaaagatgctgcagatcaatgggctttaccattcctacctgcttgtgccgtctgacggctacaaaaaccgggtaactcccggatggctgtcactccttgtcaatgccggggaagggattgatattgatttctttctccagaaacagccaaaggacaagattcagcagcgtctcggtcagcagatccgtatcaaccgttccaaattaaaggatgcgtccgataccaacactgattatgacgatctggattctgccatccgctccggatattttctgaagcagggacttgccaacaacgaagatttctattacatgaatcttctcatcaccattactgcttccacgttggaagaactgcagtggcggattcaggaaatgaaaaagctcctgatctcgcaggatatgaacttacactcctgctactttttacaggagcagggatttttatcctctctgccgctggcaaatctggacaagaagctttttaagctgtccaagcggaacgtactgacttccggggcggcaagctgctatcccttcgtcagctacagtatctgcgatgataacggaatcctctttggggtaaacaagcataacaattccctggtcattgcggatatctttgattccaggcagtacaagaacagcaacatctgtatcttaggctgttcgggagcaggaaagaccttcaccatgcagaccatggcactaaggatgcgaagaaaaggcatccaggtgttcatcatcgctccgctaaagggacacgaattttaccgggctgcaaggaatgtcggcggagaatttatccagatctctcctgccagtaagaactgtatcaacatcatggaaatccggaaggtagacaattctgtaaatgaactgctggacggaccgacactggatgcctccgcactggcaggcaagatccaaaggcttcacatcttcttcagtctgctgatcccggatatgtcccatgaggagaagcagcttctggatgaagccctaatcaaaacctatgccagaaaagggattacacataaaaatgaatccctgacagatccgcagcatccggagcagtacaaaaagatgcccattctggaggatgtctacaatgtcctgctggaaagcgaggataccaaacgtctggctcatatcctgaaccgcctggttcacggttctgcttcttcctttaaccagcagaccaatgtggacctgaccaataaatatacggtactggatatctccgaactgaccggttccagcgatcttttaacggtcggcatgttcgttgccctggattatgtctgggataaagcgaaggaaaaccgtaccgaagagaaagccatctttgtcgatgaggtctggcagctcatcggtgcatccagcaaccggcttgcagcggaattcgtactggagattgccaagatcatccgtgcttactccggagccggcatctttgccacacaggatttaaacgacttctttgctctggatgacgggaagtacggcaagggtatcatcaataactgcaagaccaagattatcctgaacatggaggatgaagaggcacagcgggtgaagactatcctgcatctatcggaaacagaagtaatgaacatcacccatttccagcggggcaacggtctgatctcaaccaacaacaataacatcactgtggaatttaaggcttccaatctggaaaaggagctgattaccacagatcggcaggagcttctggaaatccttgcgaaacagaagaaacaggctgtgtaacttttggcagcactgacgctgcccttttcatttgaacttcaagaaggaggagacttatgttacagacatacaaatcctataccagacggacgctggctatgctgctggcagtccttgtcgcagtcggcgcattgttttccggcagttttccggttcatgcagccgacggcaccatcagctataaggcaggtgccaatatcccttacggcagctattttacctcccgcatgagctttgacgggagcaatactgcctactgcgtggaaccactgaagaaaacaccttcctctggttcctattcctatgaccttttaagccagaactccccgctcagaaaagcgctctactacttaaacggcggttacggctacgataaagtcgtcaaggataaatatttcagtggctggagtgatgataacagctatgtcatcggacatctggttgtcgcttacatctatgccggtaattccgctgacaccggagctttccatggcgccccgcagtcctatattgataaagcactggaagtagccagtgccattcagggacttccgaacccgccggaaggcttccgggcattcatcgttccgggacagggcagccagaccattgccggaagctggtatcaggttccaaacggctggatcgaactgaaaaaatcttctgccaacggaagcgtatcggacgggaatccgaattacagcttaaagggtgctgtgtatgggatctatcagggtgagaagctcatccagaaactgaccactgatgaaaacgggtatgccagatccggcgaactggaggaaggcgattataccataaaagagctctctgcttccaaaggctacattgtagacaccaaagctcacaaagtcaccgtaaaagcagaacagacttctgctgcaaacgtaacagatattccgcagaataatcccatgaatctggtgcttgaaaagctggatgccgaaacaaagaaagcctccccacagggagcagcttcccttgcaaacgcagaatttacagtcaagttctataccgagcagtctgacagtgatcctgcggaagctggaaagaaaccggcacgtacctgggtattaaaaacagatgtttccggaaagatgcattttaccaaagattcctttgtaagcggcgatgccttttactataccagtgatggcaagaccgtctgtcttccgctcggtaccataacggtacaggaaagcaaagcccctgccggataccagctcaatccaactgtcttcgtacagaaaattacaggtgacggtaagcaggaaatggtttcggtataccagtcttctaccatagaagaatctgtcatccgtggcggagtgaagatccagaaacgtgacagcgagaccggagaagcaaaaccgcagggttctgccactttggaaggtactgtctttgcaatcactacgttaaatgaaaatccggtattagtagacggaacatcctacacgaaagatcaggttgtccttacacttactgccgataaatccggttctgctgcaactgcaaaagatgctctcccattcggacattaccgtgtggatgaaacaactgcaccttccggttatctgaacagcggaaagatctctgtagaatttgacatcacagaacagggaaaaatcgtggaactgactgcaaaagacaattccatctccaatcaggtcatccgcggggatctggaatttgtcaagattgctgacggcagccagaaccgtctggcaaatgtgccatttaagatcacttccaaaacaacaggcgaaagccatgtgattgtgacagatgccaacggttatgccagcacttcctccaaatggaacaaacataccgcaaataccaaccggggtgagtcttcggaagacggcatctggttcggcacctccaaaccggatgattccaaaggcgctctcatttacgatacttacactctggcggaacagcgttgtgattccaacaaaggcatggatcttttaacctttgaagtcaaggtttataaggattctgttctgatacaggttggaactctgaccgatgatgccattgagatcggcacgactgctctggatgccgagaccggtacacacatgagccagccggcaaaagaagtgaccattgaagacgttgtggaatacgaaggactgaaaaagggccagaaatacaaactgactggaaccttaatggataaaaaaaccggggaaccaatccttgtggatgaaaaaccggtgatttctgaaactgaatttactgcaaagaaatcctccggctccgtcaaagtaacctttacctttgatgcaacttccttaaagggaaaaacaaccgttgtcttcgaggaattatatcaggatgagatgcagcttgcagtccataccgacatcaacgatgaagaccagaccatctatttcccggaaatcaagactactgcgaaagatgcggacacgaactccaatatttcctgtgcaaaggaagaaatcacgctggtggatacggtttcctttaaggggctggttcctaaccagaaatatgaagtgactggaactctgatagataaagaaacaaagaaaccagtcgaagcagacggaaaaccggtgacagcaaaagcatccttcaagccaaaagaatccgctggtacggtagatgttacctttacctttgatgccagctccttaaaagggaaaacagtagttgtctttgaatccctggcttacaaagacaaggaagttgccgtacacacagacattgcggatgaaggacagactatttacttcccggaaatcaaaaccactgcaacagatgctgcttccggcacacactatgcaaaaccggaaaaagaactgacgcttacagaccttgtggaatacaaaaacctgatcccaggcaaagagtacaagctgacaggaacactcatggatgcggaaaccgaaaaacctttcgatgtggatggcaaagctgtgactgcagaaacaagtttcactccggaagaagctaacggcagcgtagagctttcctttacctttgatgcctctgcactttccggaaaaacgctcgtggcatttgaaacaatgacttttgaagatcacgaagtagcggtacatgcggacatcaaagatgccaaccagaccatctacttcccggaaatcaaaaccacagccaaagacggcagtgacggggatcaggatgtctctgcttccaaggaagcgactatcgtagatacggtcacttatcatggtctgatgcctggatctgagtacaaagtcatcggaaccctgatgaataaggaaaccggagaggctttgttaaaagacggaaaaccagttaccgctcaggcagaatttaaagcagaaaaagctggcggctctgtggaagttacctttaccttcgacgcttctgctcttgccggacaggatgtggttgtctttgaaaagctctactatacagacggaaaaaccgagcatgagattgcttcccatgaggatctgaaggatgaaggtcagaccgtacacatgacggagcttccgaaagaaccggagacgcctccggtagctccgcctgtaaagaccggcgatgagacgccgcttctcctgtatgccggaatcgccatagctgcacttgcaggtgcaagtgtcctgggcatcgtttacttcaaacgcaaaaagaaacatcagtaactcataacgaagactcctgcaggcagctcccacatggaactgcctgcttctttagtaggtgatgaatatgaaacacccccactgcaagacagatgccaagcacatccgtcattttctgaacctctgtgaagggaactggcactcctgtatctacgtctggtgccgcacttgtaacgcacaggaaagctgtgagaactctggctttttattccatccggatgaaacgggaagcccctgcatcctccctctttcagatgcagcgcttttgtttccccggataccggagccaaccgaatgtaccggaagcatgagcattgctgcttttacagagctttatctgccctatctggccgctcagaagctgcctttaaagccatgtcccattccggcactgctccggcttcaggagaaccagcaatatgactggtaacaaaaagttgcactttcaggctcttatacgtacaggatatgtaaagaaaggaggcactgcctatgttaaacgtaatttcaatcatccaatgtatcgatcaggtctttacgaacctgatatttattcccatgatttttgtcctgtatgtgaaattccgtccgaaaaagccatggaccagaaggcgcaggaacacttacctgctctgtctggtactgatcagcttattcctgctacggattttctgtgagaagttcatctttacaccggttaattatccacgtttcacagacagcggcttattcccgctcatccgagcaattttctatcccggcatctgaaaaatggggattcgtgccatttagtccgaatctgggatcagtatccgcttgcgtcctatgggaattcatcacctgcttacttacaatataagtatacagtacgtactggttattcacgtacacgttacgtatcgtgtatgtacaagcgaggtgaaaacagatgaagaaaccaaaaatcatccgctgcccttactgcggcggaacagcaatattaagagatgcatcctttgtatatggaacgcattctcatggcggacaggtttatgtctgctcccactatccatcctgcaattcctatgtcggggtacatccgggaaccaagataccaaaaggaacgctcgccaaccgggagcttcgtcaaaagcggattcaggcacatcgaattttcgatcagatctggcaacagggcatcctttccaaaccggaagcatatcgctgggtggcagataagttctgtctgacagataagcaggctcacatcggacagttcagcaactatatgtgcgaccagctcattcgggaatccgcagatgttttaaagaacaaccatattcccttccgcctccgggcagccagctgaaaggcggtgattgatgatgaccttaccactaaataaaaagcaaaaacaactggtggaaaaatccatggatctggttccgatcatgattcgttccatgacccgcaccgctgcctatgtaactgaggaagaacaacaggaattatgtcagattggatatctggctttgtgccggtcggctgtcggatttgaggaaggaagatcattccagccttatgccaaaactatcatccgtcatgccatctttgactactggcggaaaattgcccgtgaccgctccatgctctgttctctggacgaagcatcatctgaagatgaacatctccattatcgtgatttgttttcctacgaggatacacaaacaactcacccggaaaaggacacaaaccagaccttgcttcttgagcatttaacccagcttggcaccggacagtcctcaactattcagaagggaattgtagccctctatctgcaacagcagggatataccagctttgacttggcaaaacactaccaagtaccagccaatcgtgtacgggcatggcagagcaaagcacggaaactattacagcaggatgatgcactctatgcacttctgacttaaccttgaaggagggaacttttatgctgacactttatactgctgtcggaaccttaaaatttcaaaaaacgacaggcggaaaatccattcctcttgtaatcaacgatggacaagaatatggactatcggatgacgagctgctgctctggagctgtcttgccttccagattctgacgctccatgaactccaggatgcctataccctgcgccagatacagaaagaaggtccgaaaggcttatccttccaacactatctgaaccgactttccttacgcggtctggttgtaagcggaattggactgacaggggtggatgccttatatcgccttctcggcagtctgaccattattcccttgaaggatacctttcccatccggctctttggctgcgttcagctttatctggaaggaactattggtgcaaaagagtttggcagatatttaaagaagaaaccctcttcaccgatggaagataccattctgaagctggctgataaggtatccctcacgaccgctgagcttgtcacaagtatggagcaggaaaaagtaatccacaacgaatcggatattatggatgagttatacacagaaccggagacaacttaccaaacacttgtggatgatgtccagattcaccatacccagtatccagtgctgcaggctattgctaatttgtacctgaataaacaaatcacatttcatacatgttaaaggaaggaaccttatgccaaaaccatttttcacaaagctggttgccatcagtgcaatcggctttttctgtgtactttttgggtgcatcttcgggatcgccacccatgaccggctctttatcctcatgagcctcctcatcggaatctgcagcatcttgcgtgcactcagtttctaccacctgatccatacacatgcttatctgtcactggacgtaagctgcacgaaacgggaacagacactcttcgggaaaaaccagcaatattggtttgccagtgataacggaaaggaatacgccttctcactggaaaagaatatcaaactcctagagggacatcggtatcggctgtacttccggaaaccacagcagggaacagggcaatcgatgccatgtgccggagatattctcggatatgaagaactcaccgatcaactgccggaacttccggatacatccgtttagatagaaaatgagccgcccgtactgcatcacccctacagttctggcggctcattttattataaataacctctcttatttctatcaaacaatagtgtttgtatccgcttcaatgccatgagcatttgctccgggaatgtcttagttaaacttgaaagaattagattttcattctcattacacaaatattattagataaccaattcagaaatatcaatgctcgttttatagttttgttttactccgccaggagaagtaataaaaatcgtagcatattccccattttcataaagggtaatttcttttatatctttttcttcatcttggttcgtagtatcgcaataaaattttatggtatatttagggttcatacctatgcttttttctgtctctttccatgattttatatttaaagcagaaataaccttgtctatattatgcttatcatcatactttaccagcaattccttatttgcggcatcatatatctctataacttttacaccttttacataattgtccattctctgcctttttccgccccgccagatacctgtgccggtatttcagctctgcatactctgtgatccgtttcatgtagactgcatcataagctccgcctacagcaccaaccaccggaattccctgtaagaacttcatatacagaagctcttttgacaaagctcccgccgtttgttcgatctgctccttatcctgatactcttccggcagtattccgtttctgataaattcatttactttcccgtcaatctcacaaagtgtatccccataggatactgctccccggatcaataataagataaaatatttttcttccctgctttcatagctgtatccatactgcagagcagtctcataaatattctttaaaatcatccctgtaaataccggaatatccggcagaccgattcccaatacgcccatcccgattccagacacaccggatagcagtaaattctttgttcccgtatctcttgcctttttagaaaaagagcggagggatttggaattctgctttacatccgccatatactgccgcacctgataatcctgctccagttttgtccgctgatacgtcttttcaataaccccggttcctttctcgaaaatcagagcaaatgccttcgcaaaagcggtatccaatgttttctgaagtttcggcggtatcttttcctccagtttctgattcagaatgctctcccttttctctgaacgcttctgaaggaatctctgctcctgtacttccagcttttcccactccttctgaagcggtgtccttttatcaaataatcgcatcttaatacacctccgcaccaaacggcatcaatgccagtttcgccagtttaaactgctgtaaaccaaacgggattccgataatcgtcacacataaagctgtacccaacgccagatgctccagtgcaagaggcagaccggatacaatcagccagatgatattcaaaaggaacgaaccagctccgccaccatactgcacctcttttccaaaggggaaaaaactaagcgccgcaaatttaaaacactgcatccccaccggaatccccacaacggtaatacaccagagacaacctgccagacaccagctcagcccactgactgcaccgccaaacacaaaccacaacacatttcccaggcatcccatatgctacacctccccattcatccgatttttcacatcagcaagtatcttttctatccggttgatggcatcatccacctgttctcttgcatctgcaatcttgctctgcaccatataatctgccaccagcccgtccagaaagaaatccgcaaaggaaaggaagctgccgatttccatgcgcagatccaaggaaacctgcacatctcttaattctctctgaaaacgctgaatatcgcttttcgcctgttccatcaacgcagctgcgtcattcattttagaatgcttcacaaagtcactgataaagcctcctccaagcatatcaaaaatgccccagtttctcgcacttcccaacttatcccttgctgcgtaaaggctctgaagcgcccgctcccctgcctgtactgcttcctgcatttcccgtttcatcatttcgttactcatcgtttatcctctctttctttttagcagactattgcggcagattttctatatttcataataaaaaaagactcctatcatgacctctgccacaataaaagtcttgctatctcatttgctacgggtatctctcgataccggttgtcggttacaaaaccacctctttcaaggcgttcagctactcccttttttgcttgagatgaatataacatattggaaataatttgtcaaatcatgcatttttcttttccaaccgttccgcttctctggcaaatacatgcgagatatcaaacagttccggtacatctgatatggtacacacattcacacaataattgagccatggaaattcttttgtcatctgataaataactgccatggcttttgcttctgacattgcttccaccgaatgatatcccgatccctgaatatgctcaaatccgtttgcttcaaaaaagtcccttacatccgcatatgcattatgccagtcacctttcggataatattcctttagtgcttgtgtattcaggtcaaaattgatgcctttcctctgtaagctgtccatctgttagttccttataaagtctgtaatcaggttctccttttctgttccgttataccagaaacactctaacaaattctctgcaattcctacggagtttttcaactgaaagattgctgcccagaatcttccatagtcctgcttgcgtccccggtcaagataaatcctgcttccaagggctttgactgcacagcttaaatcctcctgctcaaaaatctgatctgcctgttcacacatctgatttaccgtttccggagcgagcttgcttgtatcaaatttaagttctactttatacattatactcatcctttcatacaacaaatgactgagtgactcttctctttctactgtaattctaccatgaaacctatataaagtcattccccattttcacttgctttaatataaatttttccttttattttggaaacacaatctccacacagaactcattcccttctatccgggcgctgattttcccatccatacgaagtaccagctctttcgcaattgataagccgagaccgctggaagtcttactgcgcgcttcatccgctttataaaaccgttcaaacacctgatctacatttattttttccacatgacatacttgattttttatctgtatccggatgttgttttcaacttcttccagtgaaatactgattttcttctccccgtgatccagtccgttttttatgatattctgaaaaattctctggattccctgttcatttccgttcataaacagcagtttatctgtaatctgtatctccggttcaattcctctgcccgtccattcatcgtagtaggaaaatatggtatctttcaaaatcttgttgatacagcaggatgacatttccagatgaaaagaatcgtttttaagttttgtaaaagtaaataattcttccagcatttctttcaggctgccgattctctcctgtatgatcttcatataccgtctctgctcttcctggtcttcacaggtttccattaactgaaaatatccgtcaagggatgtcaaaggagtacggatatcatgtgagagatttgtatatgtatccgaaatcatctcctctttcttcaagtattccttcttttcccttcgcttcagttccagccattcgtttaaaacatctgccaactcaccaatgcctccaaaatccatttctctggtaatcagcatgttgctgtcgtgcttcatcagaaacgacaactggcggcagatgtctttcacctgccgctggtatttccaaaataacattccttgtaccagtatcactgctatcaatagcacgaaccctagttttatcatttagatatctctctttctgaatacccatgctgtcagtaatgtaaccacgattccgaacgccgccgcaatcacaactgccgtcaggcattccttattggtcggtgacatggataaaagtgcaatctttcctgtcactgtatatttcaaaatctggaaattctccacacctgccttctggatcaaatgattgatcactccgtataagacaatcatggtattcatgcacaggcagataacaatcgtcatgctgaacacgttgctgttcaaaaccaccgcaatcgccatactgattagtaccagtgcataatgaagcaaaatctgaataccaaagtatctcagcaactcgcttccattcccccactccagatatccgaagtacatctgctgtgcaataatctgaatgatgaaataaagcagcatggtaacagtcgtatacacaaacaacacggaagctttggaaaagatcaggtttctccggctccttacctgcccgccgatatttttaatataaccgcttcctatatctgcactggaaaacagcactgtaaaaatcaccagaaacaacgccacaaacttcgcctgcaggtttgcatatacctgatcaaagaccgttactttttctcccggctgtgtcggcaggaatacggacattcccatattgatggtttctggtttcactgtttctgcaatgttttctgtctgctgttgttccgcttccttgttcatcgtatcaatatccagtttcgacatggatgtggagaagaatatagctgccgccatcacaatccataccacatacatactttttgtccggaccatccggtacagatccatttttatcatattaagcattttgattccctcctgtcagattcaagaaataggtttccagttcttcactggtaatggaaattccattgaccaaaattcctgcttttgccagttccatattgacattggcgctttcattcaatcgttcaaatatatggatatggctcttatctgtaacctgatagttggtaaatcccattctgtccagaatcgggactgcctgctccggatggattaactctatttcaatccgttcactgcagcgtttcatcagttcttcgcttgtcagctcctgcagaagacttccattatggataattccataatccgttgcaatcttagataattcctctaaaatatgactggatatcaaaatcgtcatattccgttcatctcgcagtctctgtatggtatcacgcacctctgcaattccctggggatcaagcccattgatcggttcatcaaggaccaggagatccggctccccgaccagtgccagcccgattccgagacgctgcttcattccaagggaaaaatgtttcgtttttttctttccgacaccttccagtccgaccgtctctaagatatcttcgatgtatccctttttccgaataccaaacaattcacattttattttcaggtttgtatatgcattcatgttgccatacagccccggtgcttcaatcagacaccccacacgagaacgaatcctctccagttcttttcctttacacccgaacatctcaatctctccggctgtcggtcttgcaagtccactgatcatcttcaggcaagtcgtctttcccgcaccgttccgtccgataaatccatagatagcacccttttttatgtgaaggtttactttatccactgccttatgatgaccatactgcttcgtcaatccatttgtacttaataacaattcactcaatgctttcatctccttttcttatctgctgttatcatatcggataaatcctaatcaaacgcaaataaatagtaaaaaaagagtaaagattaagaatgcagacggtagccgattccccatacggtatcaatatattcctcctgcgttactgcttttatctttttccggatattgctgatatgtacatccagtgtctttgtctctcccatatagtgttcatcccacgcatattcaaaaatctcttctttgctgaagacctgtttcggatgctccagtaaaagctccagaattgcaaattcctgctttgtaattttgggaagcagcactccggcaatccggacttcaaagcgctcacggtccagttccaggtttttatatgacacgcttttatgttccggctcctgctgcatatggcggagctgaacctgaatccgggcaagcacctcctgtatctcaaacggttttgtaatgtaatcatctgccccactggtaagaagcccgattttttcatccaatccgtctttggctgtcaggacaataaccggcgtattgccctgtttccgaatctgggcaagcacctcttctcctgaaattcccggaagcatcagatccaatagaatcaaagaaaagcccgccttatccatctggaacagcatcctcgcttccgtcccggaaaaagcctgtaccgtctcataccctgctttctgtaatgccgtatataaaagattattgatatccgtatcgtcttctacaatcagaattctgtttttctgctccatttttctcatccttccattttccgatttaaacaatattatattgcacttttataactatgtccaaaattcttttgatattatccttccacctcgtctacatatgctatatatagttctaattcttttgacatatgctatatcttgtgttaatataatcttgtatttaagtttttgtgctgtcccgtcatgggagtctggaccattcatccagaagcatatgcagtttaagtttggaaaatcgtgtcattatactgccgttttatacggtgctataatggcactttttttattttaatctattttaacgcccaaagaggcagaaaggagaatttttatgtcagcaattttaacaattttagggagggccacaagagatcctgagatgcagcaaggaaaaaattccggtacggaatatgtttctctggacattgcagtttcacagcgaggccaggatggaaaggaagaaaccatttactatcagtgctattttaacaagttccttgcagaacgcttagcaaaagcaggcgtaaagaaaggaaccgggctgatgatctatggtgatctggagcttcatccgttcatttatcagaaaggaaagaatgcggggcaggcaaatgccggtccgaggatcaatgtcaaggactggcactttgtaccatccaaccgttctgacagcaataccggacatccgggtgcaaaccagaacagccagccgaatggtggtgcggcaacgcccggtgcagccggcaatggcagctacccaatgcagggaaatcccaatggcagctaccagaatcaggcaatgcctggcggctatccacagcagggaatggctcctgctaacggtgcctacacgcctcctgcaaatggcggacagtatcaggctccgccaaacggaaccggtcagccacagagcagctacccgccgcagggcagttataccggaatgccaaattacggaggtatgccgggcagtcagccaactgacggctttcaaaatgtgccggaacagatggcatcccagttgccctattaactctcaaggaaccctatgttgaggaattgcatttatcatctttgtgatgatgcagttcctctttttcatgtccggaagcggcgatttcccatccagcttccgggcttgtctaagaatcatgaatcagaaaggaatcagctcatgaaaaaatcaaatcgaaaaaaattcttacagtttgtcgtgcttgtactgtttcttgcagcacttttcgtaccacaggatgccaaccggcttctgattgcaggcattgccctgatcggtatcggagtcacgctgttcagttatcttctcccgcttttcacggaacgcctgaaaaacagggagcataagctacgaaaacgcccagaaagaactcgtcatctggaaggaacacctgatctggaaaccattctctggagacagatcaaattccagattaccggaaagctcaaggaagccttcccggatgccacatgggattttgtgaaagaaccaccgctctcccagatactggatggggaaccattacggattcgcacacggaataccggaagttataattttgcggaaattctcatggatgcccgtggcagtctgacgcttcagatgatgaccattgaatccttacataaaaaggaaccgtcagaaggaaatccggattccagaccagccgttaatcccaaatcatggtattccctgattgggaaaccgctactgatggaattggtcggtgacttacaggcaaggggctatgaaaagctgtttatcaacgagcagggagatgtctatattctgaacggcactgaaccggaagtccggggaaagctggaacatttcccgcccaaagattactggggcgaattgacggagatttttactgaagatgaattgaccacagaagagaccgagcaggcactggaactgtcctggatctcataagaaggaggaacgaatcatggcaaataacatcgtagcaacctgggggttcaaacgcaaactcccggaaccatttgaggattatacggaccatgcaatctttgatgacattgcatccaaatactgtactcagccacggaaaaaatccacgcttcatgcagctaccctgcgggcagtccttgcttatctggagctggaaaacccggttggcagtaccccgccggaaaagcttggggcggtcggtacccaatccaacaattttgttgtggcggaatatccgagcaaaaccggtgatcttcaggtggttgtctacaaccagctaaacggaaagttttacggaggctgctatactcctccgccggatgtggaaagcacaccggaaaaatacgaatttaaagactccaaacagtccggtgcggctctgctgttcgcactgatgccggtttttctggcagatgaagagtgtaatgaaaagtatcaggaattaaaagcgcaccgggacaacggttatcccgatctggacgccgctgcggaaacagcagccgttctctgcgacaacatttaccggagaacccgctatgcatcaggtctcccgaccggtggtgttaagattgaccttccggcaaacggcgtattgtcgctgatcaaaccgttaaatatccagaagggggtctatgcaccaaccgaagtgctccatggagactttcaggtgttacgtccaggaagtggatttaagaaagcacaggcagccatttccagagatgattttgttgggaaatttatcctgaccgcatcccgaaggctgtctccggaagaggaggtatctgttccgacattggcagagtggtacatcatccctccggaaatcaaacggatctgcgaacacgcaaaactgacaacggataccacacagccgatgcggaattttcttttacggggaccggcaggtaccggaaagaccgaaggagccaaagccattgcttccgcacttcaccttccttaccgctgcattacctgttccgcaaatacagaggtattcgaccttttaggtcagattcttccggatgtggacggaaaacgcacccggcttcagcggcagtacccgtcttttcaggaaatccagttagatccctccggtgcctatcagaagctgaccggaaactatgatgaagaaatttctgccgaggacacctaccagaagctgatcgatacgatttttgatgaaatgcacagctattataaggaacacacctccggacagaacttccagtatgtggatacgcctctagtcgaagccatccgctatgggtatattcttgagatacaggagcctacggtcattgctaatcccggtgtactggttggacttaactcccttttagaccgctgtaacagcgtatatcttccaaacggagaaaccatccaccgtcatccggatacgaccatcgtaatcaccacaaacaatgactatgcaggctgtaaacagatgaaccagtctgtcatttcccgaatgaaccttgtgattgatctggatgaaccggatgaggatacacaggtagaacgtgccatggctgttaccggatgcaaggatgcaaaaacggtacgtctgatgacacgcattgtcaaatccatggctgtctactgccgggaaaatctcattacagatggctgctgtggcatgagggagctgatttcctgggtgcagtcctacatggtctgcggggatatccgggaagcggcccgttacacggtgcttgcctctgcctctgccgatgctgagaaccgtacggaagtggaagaaagctgtctggatactgtgcttgctgcgtaggacacgcctatgagaaaagcagcactcacagaagcccagatccgaaagcatctggcagataatctgtcttatctccggcaagccaaaacaccgaagttatcacaaaaggcagttgccagaatcttaaatcttcccccgaaaaccattatgaattatgaaaatgcaaactcctccccgatggcttatgccgtccttcgccttgctgtgtattacggctgcacgatggaggaactgctgacaaaaaatctaagaaaagaaaggaagaatatcacgtgaatcacagccaaagaaatttaaagaaactaatccgggcaaaagaggattccattgcggatgaggagttattcctctccgctgcctatcagaagtaccagacctcccttgccagagccgttaccggacgttaccggtatggactgcaggtactgctggactgggacatttccgaacaggcaggcgttgcatataccgacaattataaggtacatctcaacgcagcgaacccgatcacccagtctttccccacccgtttcttacgttcccagagcctgacagggctcaccgggcatgaagtggggcacttactctattctgatttcacagcccacgctgttcatctgaggagtctggaaaacggttccttctatccgaaggagccggagctatcccttccagcttatcagacagcactggaggagatcaaagaagtgttagaagaaaaggacaaagccggatgcctgacactggcacgatgcgccgcaacttttcaaaacattctggaagacatccatattgaagaccgtatgtgtgaggaattccacggcaccttccgacaggggattgaactcaataacctgcgtatgtccgaacagattccttccatacaggaacaaattgacaaagaataccagccattttccatcattgccaacctgatcctttcctattgccggaccggaaacatcaacaatcccaccggctatcagggggattatctggataccatttccgattgtaccgatcttctggatacggcaatggaatcggaaaaaggcactgaccggatgctggtttccaatgcgctcttagccctgacctggaactatatccagccgctcatcgaaaaaacacgggaggaattggaaatgcatggcgaggattccgctgccgatgctctggaagatcttctaggggatgaagtcagcagcggcgctcctcttccgaccggaaaaagcggtgccattccaaagaatatcaaaccagcttccccaaaaggaagcgggaatgatgagggcaatgctccttccggtccacgtaccaaagaggatgctatagaggaagccaaacaggtgctttcggaagaaggcgggcgcatcgctcttacaaagaccaataccattctggatgaaaacaaccccggcgtcacttatgtcagtcagtatcagggcagcggctatgagcatgctgcagaggatctgttccggatcttgaacgatgtggctgcagaaaaggtgcaggaagactgtcagacggaactgaccgaggaactgcagaaaacagccaatgatattcattacggcaatgcccatgcaggcatccatgttaccatccatcgcctgaccagtgtttccgattacctgaagaatgaataccagacagttgctcccccgctcctgcgggcttccaaaaagctgcaaagcaccatcctgccgcttttgaaagaagaacagcaaggcggaaagcagaagaatctcctgtttggaaaacgtctggactcccatgctctctataagacagacggaaccatctttaccagaaccagacttccaggagaggaaaaacgtctggctgttgccctcctgattgacgagagtggttcgatgggttggggtgaccggatgacacatgcaagaaagactgccattgtcctttatgatttctgtaaaagcctcggtatccctatcaccatttacgggcattccacggatgcaggcggcgttgctctttactcctatgcagaatttgattctgtggacaatgaggactgttaccggctgatggatatgtgcgaccgcaacgggaaccgggacggcgcagctctccgcttcgtagcagagcatttgtgcacacgcccggagcttcagaagctgctgatcctgatttctgacggtcagccagccgattacggctacagcggaacggaagcagaggcagatctgcggggcatcaagaaagaatacgaaaaacgggatgtcatcctgtttgcggctgccattggtgacgataaggaaaatatccgcaggatttacaaggacggattcctggatatcacgaaactggaagagcttccaaagaatatggcacagcttgtcaaacagcatctcaaataaaggaaggtgaatactcatgaatgaaacttatcaaaaccggattaccgaccagatctgcaagatccagaatgaccgggcactcattgccttttatgaccggctccgctacgcaccactcggcaactatgcacagctacatgccaaaggggaatatcaggaaaacgggcataaagtacattctttaatctgcatcaccattcaggattattccaacggtaccggagaccggaatatcatcacccgtttcaacctggcaccggaacagatccagttcctcttaacccggatcacttccggttttcaggaatttgaatggagccagagcaagatctacggcaatcccgatcagaacggttattccacagcccagatgttttatatctccagacatccctatgattccaaagggcagcctatgaaaagcccatggaaaatccagattgtaaatgggaaaggcatcaaagcacagaataagaacggtggttcctacatgcagccacgcagcttccagtccgaaaagacgacagccatccagcttaccgacatggatctgttcacgcttctgaagcggacggattcctatatttccaactgggaaacggtgattgctgcatcactgatcaataacggaaaacggatgctggcagaccagcagaacagtcaaatgcaacagacagcacaggctccgccttacgctgcctaaattttcagaagagaagcggtactttactgcttctcctctttttaagaaaggagactttagttatgaatattgcactcatccggaccatggactctcaggggcgtatcgtcatccctgcagaaatccggaaacaaatgaagctctcagacggagatgcactggaactggaaaatgtgggaatggagctgcttttacgcaaatgccctacccacttaaacggaaaagaggaaatggcttcctatctttccgtcctctacagtgtcatccactgtggtatcgcaatttgcagtgaggctcacatactcgtatctgcgggcatctatcttccggaaggcactcccgttacagaagaactcgccgaattggttgcggacggccaggaactgatctctgctgagaactgccctgtctacccggtatccaacacccgtcaaccggtttgtgcttttttcccgattttaagggaagacagagagccgctggcacttcttctctgttccagaaccggacagcatttatccgagatggaattgggatgcgctaaactggtcgctgccgtaattgcaaacaaaattaagtaaggaaaggagcgtgaaatcaatgaagaatacaaatataaccttacacaccacccaaaagaaagaatatgtcctcaccggaatcctgtccctgcccctccatctgggagaacgggcgtggatctatagttataaccagacctttgctaccagtccggtgcagagtattctggaagtatccgaaaacggtgtggtatttgagacctgcaacagtatttaccgtctcagctacacccgtgttccgatggagctggaggcgatgtgtgcttgacaagaatggaagaactggagagctgcctttcggggctcctctccaccttaaagaagaaccgggaacatgtgcctctggaagtgctgaagacacagtataagcagccgtatgaagaactggtcagaaacatcaacctgaccgcttctgcctatgcaaaatctgtgctgctccaccggctggtcctgaatccggatgcagatgtggaggaacaatgtaccgtcatcaaccagatgatacaaacttccgggatgctgaagaaaatcagctcctgcatgtccaaaacctatgatgtaggacagatatatcctctgatactggaactacgccatatggtcgaacaggcactctggccctatgtgaatcaggcaacttgtctggtcgcagatctggatgatatagaaaaagaaccgacaatttacaattttttgacacatgaagtttatgaaaatgatacctggattcaccgagaaatcgacctgcgctggaaactactggtacatcttactcccgaacaaagagaatccgtaccaccagccaatcatagtatgaatggaggaatttaccatgaaagaacaaccatctaatccttgcgagaaagtctcatttattttgacctatgaccagcttgaagctgcttataacatctaccgggaacaatttatttcctgcgacttcatccgccgctccatggaacgtctggaggaaagaatcggactctgcaaccttccatatgaaacgctgcgtgatgatccaagccttcttcatgaagcatacctgcagtttctccgactggaagactgcaatgtggcttataacgacacgctggagcaggtaattgatgcaatcgaacaatggcttgcctctgacaccttatcccctgtaaaccttacggtttccaaccagaatatgggtgaaacttttggaacggaggtggatgtgtaatggcaaatatctgctgtgatgatgtgatcttttatacagaaggaaatccggaaggactatatgacttgtgggaggacctggaaacctacatcattctgaaccagaatcctgatttatgctggattggcaatttattttcccacaagaaaatagattccaccggaatatctcttcgtggaaatgtcagctacatggaatggaatgatacgtatattctactttctttagagacagcatggactccactttatgaagcatatcaggcgatagccgctgcatatcatgttccctttgtgatgcaaagcatagaacctggagaacgaatttattataacacggatgaagcacacctatttttccctgaccgatattgtgtccgcttatatgaagaaagcctattgactccatgtggcttaataatcggagaaaagctggaagacggtgaaccatttgaaacggaaacagacgtattagaacgattcagagattgcggatatccagcagctacactaaaagagttggagctcatgttcgatgcggatgaacttattatttttgaatttacaaatccatatttggatctggagcagaaaaatgcttgtgcatgaaacttctcccctccacaccaaagacgattatcatcagatttaaaggaggaacaccatgactgatttggaactggatgtctgggatgcatggctcagggaacgtcaggaacatctggaagaaaccctgtccaatatctcaccatcggaagaaccctgcagatattacctgctaaccggatatattcagggaatgctagaagctcttaccatgcttacgactgttgaggatgggaaacgcttcaagatcaaactggagcaatttcgccagaatctgctcctctctggagattacgatgctaccggtaactataaacaggcagtgaagaaaactgctgtttaaatacttcgagccgcccaatcggacggctctttttatgcccgaaaacggtagcctacaccacgtatcgtttctatgtagtgcggttcttccggattttcttctattttctttctcagattcttgactaacccatagacacggttatccacttctgactccacatcctcataaatatgctggtaaatctgttcttttgtaaatacccgattgggggataaggccagataaaaaagcaggtcatattcatgtctggtaagttccacaaccttaccatctttgattacgctccgctgaagctggtctatttccaaaccttggaatgtcaacttttcagaatttgtaatctccataacttctaacgtactttcgcaggctagaactgatttaattttattcaggattccctcttcggaatcagaaatggtaagaatcatcactttcccataacatcacctgcttttcttagcatttagctttcactcctcattaacaatgtttatcgattggtcacatagatatatgcatcttccaagtatcttgtctatgagtgcgtttataactgttgcatccagttcttttaagccttgataatttcggataagggcgaggaagtcacggattccccgtgatttctcgtagctttcattaagagtttccgtcacctctttcagccttgcttcaatttcaagctgctctttctggtatttccccgacatcatctcaaaattccgctcggtaatacgctccatgaccttatcctcgtagagagaggaaaacagcctgtccagttccgcaaggcgtttgttcagcttcttacgttctttctctaatgctttcgccctgctctggtctgtttccgtgagccgcttttctatggccctgaccgccttttcatcattcactgccatatccgcaaaacagttgatgtcggcaagaacggcattgaataaatcccttgcttctatattgtgggcactacactcgcttcttccgtttcttgcataattattacatgaatactgtacacagtcgataatctctgggcgtttcctcctgtgtacgttcattgcccgcagagcacatccgcagtccacacacttgataacgcctgcaaaaatatttacaaatcctcccttgttctgtggaagcctacgacttgtaataagctgttggacaatatcaaattcctcctgcgtgactattccctcatgggtattgggtatcacttcccattcttcgggcagcttagaggggcgtttcttgcttttcatattggcggcaatccgtttgtagcctacaagatttcccgcatatatcgggcttcttaaaatgctcctcacgctgttcccactccaaatatagcgtttgtcctcgttcccctcaaaatgacgttcaaagcctgtttcgccacgctccgccgcataagcggcagggcgtaggatatgctgtttattaagatgtctgcaaattttggcaactccattcccttttaatgcaaggtcgaatatctcttttacaacatgtgccactttatcatctatcagcagatggttgtggtcggcagggtctttgatatagccataaggggcggtagttcccatgaatttcccctgttgaaacctcgcccgatatgccgattttatcttaacagatatgtcagcggcatacatttcgtttaaaatgttgcggaaaggcgtgatgtccatagcagatttattcaaggtatctacgccgtcattgaccgctatatacctcacgttatgctctgggaagaaaacttccagatataacccacaatcaagatagtttctccccagcttcatactgggggacatatccgagtgaaacggacagcacgccatacctgtgcgacccactttcaagccataggcttctgcggcttgtcgggcagtaacattttcttttacaatttcaaatacattcatgtgactcctttcctgaaacgaaaaaagcacctgtcattttcaaaacgaaaatagcaagtgccttaaagttccatatttaattttaggtgcaaaaaagcaggagaccttttcagatttcctgcttagcaaagctgtgaagatttaattgtggttgggttgccagttatacaaactgggatttatataattattcctctaactttccccattttataggctttcctgcctgtccattagtgaaatgatatgtagtttcccttatttttgcccttatgagataatcacaagggaaataagggaattttttttaatcattgcctaccactttatcaagaagccgaaccgattttcgtttcgcatgggattgaacgtaatatactgttttggaaatactgcaaagcggaaagactgctgcatgactgcggaaaaagaatggatgtaatctttgctgtaaccctttctctcttttccatcgggatgaactcccccgaaggaaagcaaatcaaagaaagattgcaaatgctcagaggttacattttttaatttccgttctgccagcggatgtttcttaatatttcggattgttccgaggtaattctccacagtaccattgctgagcgtacctgtttttaattcctcctctgcccacacatccagaagttgtccgactgtgagattttccgctttggcaacaaatttctttttctcataatcatccattgcctgacggagcagcttttcagtttcacttttgctttctgttccaacgcattctttctgaacaagattgccgcttgcgtcctctacatagaagcggtagtaccatttctttcctttttttcttacagatccttttgccataatcgtatgtctcctttcgatattagacaagcgtcattctctttttttatgcctgaacgcagggaaaggaggattacggaaacaaatgattccggaactggcacgccacaaaagaaaggagactctatgtcagtcaaaagaattaagaatcttgtaaaacaactcaatgaataccgtcatgcctactacaatcaggatgcccctctggtatctgatgccgagtatgaccgactctttgacgaactgaaggaactggaggaacagactggtttcatcctgtcaaattctccgacacagacggttggatattatccggtcagtgaacttgccaaagtcacccatccgattccactgctctcgcttgagaaaacaaaactgatttcagagcttttagatttcatgaaaggacaggaagttctctttatgctgaaactggacggtttgactaccaaactcatttacgaagatggcagactgattcaggcttctacccgtggagatggtgaagtgggggaagatattacacacaatatcccggcatttttaaatgtaccgcttaccattccacacaaagaacgtctggtcattaccggtgagtcttttataccaaccaatgattttgaacgtctgaaagatactctgcgtgatggaaatggaaaaccttataaaaacggacgtaattttgcttccggatcagtacgaagtcttgatccgaagaactgtatcggacgttgtgttcgctttcttccgttcaatgtattagaaggaatggaggatgttcccttcccggacagcagagcctgcaaattagaaggtttaacacacctgggctttggttactgcccgtttttctcaatttcaggaaccggactttcaaaagaatatgcggagaaattcattcaggaattggtatccacagcagcaaatttacatcttcctatcgatgggagcttggtatttacccggctgtagatccactggaatctacttcacgtattctggatccacacattgtcggagaagaacactataaagtagcccgtggagtacaggaaattcttcagaaatacaaagaactgcaggatatcattgcaattcttggtatggatgaactttccgaggaagataagctggtcgtatccagagcaagaaagatccagagattcctttcccagccattccatgttgcgacacagtttacaggtctggaaggacgttatgttccaattggcgagacaattcagggatttaaagagatcctcgaaggaaagcatgatgatattccggagggatatttcctgaatgcaggtaatatcgatgacgtgcttgcccgtgtgaaataggagggacgtcctatggcagataaatttaaacttaacattatttcgccggaaaagaagtttctggagggtgactgcgaattccttgaatttgtaagtactgaaggagaacttggtatctatgcaaagcatattccgctgacgacgattcttgaaccatgcgtgatgcgaatccacaatgacggggagattaagaaagcggcaattctcggaggatttgtagaaatcctgcaggagagggtaacggtgcttgcagaagatgcacagtggccggatgaaattgatgtggcacgtgccgaagcggcgaagaagcgcgctgaggacagaattgctgcgaagcaggaaggcacagatatgcgccgtgcagaggcggcactgaaaagagcagttgcccgaattggagcaactcagtcataaaacattaaaaaccgagaatcctttgttggattttcggttttttttaatgaaggaaaactggacaataaggaggaatttgcctataataatttattatataataccagggtcaaaggggtcaaaataccttttgaccccaacatcattatatagcgtaaaaaagagtatgaatggcaggataaaattgagaggataaagggatgaacaaacaggaccaaatgacaatgcaggaagcggaaagaaagatggaatctttgagggaagtgtttcaggttgtcagactggtagacgggaaaatgctgatggatcgggaaaaacggataaatgcaggagatttatctgaaacgtgtcagtgttacagtttctggaaaaaagacaaggaatgcgagaactgtagctctcttctggcactgaaagaacagacgcagaagataaaatttgaatttctggatttgcaggtatttcaggtgatctcgcgttatgttgagattgatggcagaccttatgttatggaaatgattcagaatcttgatgagagtattcagattgatcaggaggggtatgataagctgatcagtaaactgtcaggatataatgaaaagctatatacggatgtactgactgggatatataatcggcgtttttttgaagaaaagatcaaaaacatggaggatgaagccggaattgcagtgatcgatctggatgattttaagcttcataacgatacttatggacatagtgcgggagatgcggcacttataacgactgcgaacattatcaaaaaatatatccggaagacggatattctgatccggtatggtggagatgaatttttactgatccttccttcgattaagaaacatatttttgaagataagctaaaactgatccgggaaaaaatccacgatacggttgtgccgaagtatgagaaaatgcagctttcggtcagcatcggcggagctatattccgcgaaggcaatattgaagatgctattgccagtgctgacagacagatgtatatagctaaaaattataaaaatatggttgtcacagaatgggatgaaaatggaaagaaaaaggaagaaaattctgcatcagaaaaactgaaacagcagatccttatcgtggatgattcggaaataaaccgcgagattctgaaagagattctgaaagaggactaccggattttggaggcggctaatggagaagaatgtctggaacaactggaacggtctggaacagggatctcactggtgctgctcgatattgtgatgccggaaatggatggatttgaagtccttgctgcgatgaaccagaatcattggattgaagatattccggtaatcatgatttccagtgaagattcagatagctatatcagacgggcatatgagatgggtgtttcagattacatcagccgtccgtttgatgcgaaaatcgtatatcaacgcgtcctgaacatgatcaagctatatgcaaaacagaggagactgatccatctggtgaccaggcagatttacgaaaaagagagaaataaccggatgatgatcggtatcctgagccagattgttgagttcagaaacggagaaagtggtctgcatgtgatccatatcaatctgatcacacagcttttgctggaacaactggtgaaaaagacaggaaaatatcagctctcatgggaagatagattattgattgcaacagcatcggctttgcatgatatcggaaagattggaattgacgagaaaattctgaacaaaccgggaaagcttaccaaagaggaatttgagattatgaagacacataccttaatcggtgcacaaatgctggataatctggatatgtaccggaatgaaaagctgctcaagcttgcacatgagatttgccgctggcatcatgaaagatatgatggaaagggatatccggacggacttgtcggagaagaaattccgatttcggcacaagtagtatcgctggcggatgtgtatgacgccctggtgagtgaacgggtttacaagaaggcattttcacatgaaaaagcactggaaatgatccaaaatggtgaatgcggtacatttaacccactgttactccagtgtatgaccgaagcacaggataaattaaagacaatgatggaagtagcagaaaaagaataaaaaggagtagaaaagacagaatgaaggcacttgtaattgcagaaaaaccttctgttgcgcgtgatattgcgcgtgtacttaaatgtgggaaaaagataaatggagcaattgaaggagagcgttatattgtaacctggggacttggtcatctggttaccctggcagatcctgaagattacgataaaaaatataaagagtggaaaattgatgtgcttccgatgaagccggctccatttaagcttgaagtaataaagcagaccggaaaacagttcgcagcggtgaaaacacagattcaccgcaaggatgtgaatgaaattatcattgctacggatgcaggacgagaaggagagctggtagcaaggctgattctggaaaaagcaggaagcaaaaagccaatcaagaggctgtggatctcatctgtaacagataaagcaatcagagaaggttttgcaaagttgaagaacgggcatgagtatgatgcgctttatgatgctgcaatgtgccgtgccgaggcagactggctggttggaatcaatgcaacaagggcactgacctgtaaatataatgcgcagctttcctgtggacgtgtgcagacaccaacgcttgcaatgattgcaaagagagaagaaaagatccgtagttttattccggaaggttattatggaatgactgcaaaaggacaaaatattatgctgacctggcaggatcagaagtcaaagagttatcgctcattcgataaagagaaaatgactggactgatgaaaaagctggatggacagaaagcggtagtggaagagattaaaaaaacaccgaaaaaaacgtatgcaccgcttttgtatgatctgacagagctgcagagagaagccaatcagcggtttggatattcggcgaaagagacgctgaatatcatgcagagactgtatgagaatcataaggtgctgacctatccgagaacggattccagatatctgagcaaagacattattccgacgatcaaggaccgtctggaggcgtgtggtacaggaccgtaccgtaagcttgcaatgacagcgaagaaaaaggatctgagcggaaagctcgcttttgtaaatgatgcgaaggtatcggatcatcatgcgatcatcccaacggagcagtttgtggatctgagtcatatgacaaatgaagagcggaagatttatgatctggttgtgcggcgttttcttgctgtgctttatccgccatttgagtatgagcagacacaggttacggtgaaggttggaggtgaaactttccttgcgtctggaaagattgtgaaagcgcagggatggcgggctgtttatgaagaggaaatctattcggctgaggatgaagaagaggaagaagcatatgagtctggaaagggtttgaaaggacagacactgccgaaactggaaaaaggacaggagattaaaggacttgtgttgtcattgacagaaggtaaaacgaagccaccggcacattttaatgaagcaacacttctgtcagcaatggagaacccgacggcttatatggaaagccatgacaaagcgatggcgaaaacgcttggcgagacaggaggattgggaacggttgcgacaagagcggatattattgaaaaactttttaaaagctttttgctggaaaagcgtggaaaagatatctatcttacatcgaaagcgaagcagcttctggaacttgtgccggaagagttaaaacagccggaacttacagcagactgggaaatgcgtttgtcgcagattgcgaagggaaagctttcgcggaaggattttatgaaggatattgataaatatacggatcaggtggtttctgagattaaggcgggagctggaacgttccggcatgataatctgacaaatagtaaatgtccgcgatgtggtaagagaatgcttgcagtgaaaggaaagaacagtgagatgctggtttgtcaggacagagagtgcggataccgcgaaacagtatcacggacaacgaatgcgagatgtcctgtgtgtcacaagaagatgcagttgaaaggaagaggggatggacagatttttgtgtgtgtctgcggacataaggagaagctgacatcgttccaggagagacggaagaaagaaggtgcgggagtcagcaagaaggatgtgcagaaatatttaagacagcagaaggatgagccggtgaataatccatttgcggatgcgctggctaagattaagttgtaggtggcgaatggggtggcgtgtggaaggtttggctttctggtacgtctcattgacttgatggctgtagtacaaaacggaaccggaaagtcaaaccttccacacgcctgtgcattggcagacggggatgttgtggcgaagtggaaaaaacagagtttatttttacttatttattgcttttggatgaacataggcttaaattcatgatatttttcaaaatgggactcatctacacgtatgaaagcagatccgattttggcatgaagataagggataatatcgctgtcgtaattgcagatggtgttgagtgcaaagacatgatgattatccggattatccatatattcgtcatcttcattaccagccatgaatctccagccactgtccggattcccttctgttggctcttcgcggagcatgtagccgactttgtagccttcttttgtgatcttatcggaaacgatacaaccttccccattcggctcgtcccattcgattagattttcaatcggaatttcgataaatccctgctctttttctgccatttttttccagtattcttttaaaatatgaagcaatgcttttgcattttctgtttctgtggcagaattgtattccttcatctcactaaaggttccggattcactgacgattccaagaagccattttccaaagaaagatttcttgaatttaaagatcatacatttgatcccatcctcatcctcaaaagaagctgtatactcaatcttcgccggtttccgccccagctcagccggatcagccaaccagttttcaagttcctccatagcattcacaatttcattattcataactttgcacctcactatttataataattccatgttgattgatttttctgtaaagccatattttttgtacatttcatatgcagccacatttttagcgtttacctgtaattcaatgccatcaaaatgtttctctttttttaagttctttagcatttcaaaaaaatgatgtccgatacccatacctctgtaattttcatcaaccgccattgtatcgatataaattacatcacgggtaagcatcgaaggaaattcaatatgccggtatgtaagctccagaattccaataatcctgtgctctgattcggcaacataaaaagcttctttatccaaagcatcctgaaaagcatccaaagagaaaaaatccttactttctttgtaaatatcaggccgccagttcacatgcaaagcctgaacctgattcaggatatgtactacactgtcaaaatcactggtttccgcaggtctgataattatatccatatatatcctccttcgtaaagcatgaaaaaatatatacctataattcagtataccataaacccaattatttcaatatagaatatgtcctttttacaaccaaaatccagtaaaataaatccccacacaatatcccaagccacaggacaaatgtccgcctggcgcccgtcctgaacaacactcaacttcgcgagtagagttccgggacacccctccgtcttgaagcgcgcagattttcgggcaatcctgtttccggggcatatgcaggaacgttacagggagttaggagaagaaagcggcaagaggtggacaccagccgtgcctcccgcacgactggtgaggacagcctgaaccgcgaaatcatcagatttcggggcgaatctgtccggtgccgccacttgccgcttccttccccgttacctccctgttacattccgaatccgccctggaaacaggattgcccgaaaatcgtcccccttccacacccactcccaggaaccccactcccccataccgcatacactaaagcatagaaaaaagaaatggaagtgccagacatggacctgagattgccttattatatgatgtatccgattccatacgcatttgacgaagacaaaatccagaagcgcgaccgggaatacctgcaaagtatgtatccggcaacagcaaaaaagatttttccatatatacaggaagaatgcgaccgccaagaatatgaaggaagcatgatctatgatgagtacccggataagctccagctgtgcctgatgtgtcgtagggcgtatgaacagatcatgaaacaggaaaaatgggaaaaagagacctatactccggaacagatccgggagatcgtagaaatcctgatgtaccaggaattgatggaaagaagaggaaaaggcaggcggcaacaggaaaaaacagttgcttcatgcacaggacttgtgctataatatcgtccgatataaaaatgacagcatctgaaacacagtttcggtaaggagtgagccagggtacatatgaagaatattatatttatcggaatgccggcagttggaaaaagtaccgtcggagtggtagtcgcaaagcggcttggatacgagtttattgatacagatctgttgattcagaagcaggagaacagacttttgcgggagattatcgcagaagaaggtctggacggattcttaagtattgagaatcaggtcaatcgtgatgtggaagcggaacatgcggtgatttccccgggaggaagcgtagtttactgtgaagaagcaatgaagcattacaaagagatcggaaccattgtttatctgcatgcgtcatttgaggttatcaattccagactgaagaatgcaaagaaaaggggagttgcacttcgggacgggcagacgctgaaggatctatatgacgaaagagtagtattatttgaaaaatatgcagatattactgtttcagaggatggactggagctggaagaaaccattgaaaatgtaatggaagttttggaaaatcaataaattttttaaagaaattattacaaaagttttacgaaaatgaagaaggcaagataaataattttgcaatgaatatagaaatatgctatactgatatgtgatatagaggattatacaaaaagcttcatacaaatcctgagagatctggaaagaataaaaagtatgaggttttttattcatgaaataataaagagtatgaatagagtgtttgacagaagtatagaacaggatatatttcagagggaaagaaatcgttaattgaggtgcgaaatggaacagtatattattaagggtggcaatccgctggtcggcgaagttgagatcggtggagcaaagaatgcagcactggcaattctggcagctgcgattatgacagatgagacagttactatcgataatcttccggatgtcaacgatatcaacgttctgctggaagcaatcagtggaattggtgccgaggttgaccgtattgatcggcacacagtcagaatcaacggaagcaacattgaaaattttgatatagaatatgattacatcaagaagatccgtgcatcttattacttgctcggagcacttcttggtaagtataaaagagcagaagtcgctcttccgggaggatgcaatatcggaagccgtccgatcgaccagcatctgaaaggttttcgtgcgcttggtgcttatgtggatatcgagcatggcaagattatcgcagaagcagagcgtctgatcggaaagcacatttattttgatgtggtaagcgtaggagctacgatcaacgttatgatggcagcatcgatggcagaaggacttacgatccttgagaatgtggcaaaagagcctcatgttgtcgatgtggcaaacttcctgaacagtatgggagcgaacattcgtggagcaggtacggacgtgatcaagatccgcggtgtatcccgccttcataagacagattattctatcattccggatcagattgaagccggcacatttatgtttgcggcagcagcaaccagaggtgatgtgactgttatgaatgtcattccgaagcatctggaagctacgattgcaaagcttgttgagattggatgtgaagtagaagaatttgatgatgcagtgcgtgttgtgtccaaaggagatcttcacaatacacaggtgaagactcttccatatccgggattcccgacagatatgcagccgcagatcggtgttacacttgctctttgtaaagggacaagcacgattacagaaagtattttcgagaatcgtttcaaatatctttcagaacttgcaagaatgggtgcaaatgtcaaggttgaaggcaatgcagcgactatcgaaggcgtagataaattctcgggagcaagggtcagtgcaccggatcttcgtgcaggagcagcacttgtgattgcaggaatggccgcagatggcattacgatcgtagatgacatcgtatatatccagaggggatacgaacgttttgaagagaagctcagaagtctcggcgcagtgatcgagagagtttctacagaacgtgagatccagaaattcaagttaaaagtaggttaagacaggaattcctgttttgatagaacatatttccccaaatgtatattgacggaagttatggacagtgttatgatgtgtagcggtaacaattaaatacgctttctcttattcagagtggtggaggtacaaaggacctgcgaagccacggcaaccccggtaagccggaaggtgccaacctgagcgagcaatcgaacaataagaggattgatgatgagatatcaggtcagtcctttggggctgacctttaaatttgcatagacagaagagaaattctgtttgtcgattttcattattccagagataagagaggcagatacaaagaagaaaagaaagaaaggaaaaaagatggagagattattatttacttctgaatcagtaactgaaggacatccggataagatgtgtgaccagatttccgatgcgatcctggatgcacttatggagcaggatccaatgagccgtgtagcttgcgagacatgcgcgactacaggaattgttatggtaatgggagaaattactacaaatgcatatgtagatattcagaaaatcgttcgtgatactgttcgcgaaattggttatacaagaggaaagtacggatttgatgctgacacatgtggcgttctgacagcaattgacgaacagtcaagcgatattgccatgggtgttgataaagctcttgaagcaaaggaacacaagatgtcagatgaagaattggaagcaatcggtgcaggagaccagggaatgatgttcggatatgcatctgatgagacagaagaatatatgccttatccgatcgctcttgcacacaaacttgcaagacgtcttacagaagtaagaaagaacggaacacttccatatcttcgtccggatggaaaaacacaggtaacagtagaatatgatgaaaatggagttccggcccgccttgatgcagtagtactttctacacagcatgatccggatgtttcacaggaacagatccatgaagacgtgaaaaaatacatttttgatgaaatccttccggcagatatggtagatgagaatacaaaattcttcatcaatccgaccggacgttttgtgatcggtggaccacatggggacagcggccttaccggacgtaagatcatcgtagatacttatggtggaatggcgcgtcacggcggtggagctttctcaggaaaagactgtacaaaggtagaccgttcagcagcttatgcagcacgttatgttgctaagaatatcgtagcagcaggaattgccaaaaaatgcgagatccagctttcttatgcaatcggtgttgcacagccgacatctgtcatggtagatactttcggaacaggaaagattgcagatgataagcttgtggaaatcgttcgagagaactttgaccttcgtccggctggaattatcaagatgcttgatctgagacgtccgatctacaaacagacagcagcttacggacactttggacgtaacgacctggatcttccatgggagaagttggataaagtggatactttgaagaaatatctttaataacaggttctgaatttgatcgttttagaaaaaatttagaaaattttacgggtgctttgatgtgaagcacccgtttttatgatatgctattagttatcaggcagacttgcgtgagcgccatacggaacgcataaccgggcgtgcatgatgaatggaggatgaatatagcatgaaactaaggacgaaactggtgatttcttttgtgacgatgatcatgataccgactatcctgacaacggcatttatatttggaattgcgcgttatcagatcggagtcattgagcatacttatggaattaccggtgaggaatataaagattttgcaaaatccatcagagtgctgggagatatgccggagatccagcagtttattataagcgcatgtatcgcagtagtcctgattctggcatttacagcgatgatcatgatggtgtggatttatggaagtatcatcagtccgattcacaagttgcaggaagcagcgcagaacgtagaagaaggcaatctgaattttgagatcaagccggaaaaagatgatgagatgggacggctgatgcaggcatttgaaaagatgcggatccgtctgagagataatgcagaggagaagctgaagagtgaccgggaaagcaaagaactgatcagcaatatttcccatgacttaaagacgccgatcacagcgatcaagggctatgtggaaggaatccgtgacggggttgcagatacgccggagaagatggaaaaatatatcggaaccatttataataaggcgaatgagatggatacgctgatcaacgaactgaccttatatgcgaagatcgatacaaaccggatcccgtacaactttgcaccgctttcagttaacgattatttcaatgactgtgccgaagatattgagatggagctggattcaaagaatgtagagtttggttatttcaattatgtagagggtgatcaaaagatcattgcagatccggaacagttaaagagagtgatcaacaacattgtcagcaattctttgaaatacatggaacgagagcacgggctgatcaatctgcgggtaaaagacgtaggtgattttattcaggtagagcttgaggataacggaaaaggaatcgcagcgaaagatctaccgaatatatttgaccggttctaccggacggatgcttcaaggaattcatccaagggtggaagcggaatcggtctttcgatcgtgaagaagatcattgaagatcacggtggcaaaatctgggcgaccagccgggaaggtgttggcacagtgatgtattttgtaatcagaaaatatcaggaggtaccgataaatgagtaagattttaattgtagaagacgaagagagtattgcagatctggagaaagattatctggagctgagtggatttgaagtagaggttgcaaatgatggacagacagggcttgataaggcgcttttcggtgattttgatctggtgatcctggatctgatgcttccgggcgtggatggctttgagatttgtcgtaaggttcgtgcggaaaagaatacaccgatcatcatggtatctgcgaaaaaagatgatatcgacaagatcagaggactcggacttggggctgatgactatatgaccaagccgtttagtccaagcgagctggtggcaagggtaaaagcacatctggcacgttatgagcggctgatcggaagtgccgtggaagagaataaggtgatcgagatccgtggacttaagattgataccactgcacgccgagtgtgggtaaacggagtggagaagaattttacaacaaaagagtttgatcttctgaccttccttgccagtcatccgaaccatgtatataccaaggatgaacttttcagcgagatctgggatatggaatccatcggagatatcgcaacggtaactgtgcacatcaagaaaatccgtgagaaaattgaatatgatacctcaaacccacagtatattgagacaatctggggtgtgggatatcgtttcaagatgtaatgaaaaagaataaaaggaaagagattacagtatgataaccagtacaggaaatgccagggtaaaacagcttgttacatggcagaaaaagagaaaggcacgtgatgaagaaggcgtctatatcgtagaagggatccggatgtaccgggaagctccgcgtgcgcaggtgagagaggtttatgtatcggagcagttttacagccgatatggagaagagctgggactttcggcatggggaagacagatggaaattctgtcagatcatgtattttcccacgtgtcagatacaaagacaccacaggggatcctgcttgtgatggagcagaggagctgtgagatatgtgagatgctggatctggatgcgcagggaaggaaaccgcttctgatggtgctggataatctgcaggatccgggaaacctgggaaccattctccgtgcaggggaagcggcaggcgtaaccggcgtgatcatgagtcacgactgtgtggatatttacaatcccaaggtgatccgttcaacgatgggatcggtttaccgaatgccgtttgtgtatgtagagcatttgccagaaactctggaagtacttgcagaagccgggattcattcctatgcggcacatctgaaaggaaagaacagctacgatcaggaggattacacaagagggacagcatttttaattggaaatgagggtaacggacttcgggatgaagtggcagatgtagcagagtgttatatcaagattccgatgtgtggagaggtagaatcactgaatgcggcggttgcatcttcggttctgatgttcgaggcggcaagacagcgacggtagtgatgaggggaaatcaagcgcaaaggagagtgtgatttgatgaaaccgataatcgatttaaataaagaatatggattggtattcgatggaggaggagccagaggtgcgtatcagatcggtgcgtggcgggctctttcggaagctggtgtgaagatcagtgcagtagcgggtacttctgtgggcgccctgaatggcgcccttgtttgtatgggagatctggagaaagcaggacatatctggaaagagatggcattttcccgtgttatggatgtggatgatgagttgatggaacagttctttgatggagaggcatccataagagagattttgaaaggtctctggaagaagcttgcagatggtggaattgatattacaccgcttaaggaattgatccatgaggttgtagacgaagaaaagatcaggaaatgcggaaaagaattctgccttttgacattttctgtatcggatatgaaggaactggatctgagtattgaagatataccggaaggtcttctggaggattttcttcttgccagcgcatatctgcttggatttaaaaatgaaccgctgcacggcaagacatatattgatggtggtgcggtcaataatgtgccgaccgcgtctcttctaaaaaggggatataaggatctgatccaggtaaggatctttggtccgggaagagtgccgaagacgacgattccggaagacggctctctgctggagatcgaaccgagagtaggacttggcagtattctcgaattttcggcaaagcggagcagacagaatttgaaaattggctattatgatgcaaaaagagcgctttacgggctcactggatcgatttactatattgaagaaacacgagaagagtgttattatgtagaaataatgaagcttttgagcgaacttgaaaagacggaatatcgtttcaaactcaagttgccgatcggctgttcagacagagagttgttctatggaatgctggaggcaagtgcgaagctcatgagaattccaaaatataatatttatacagcagatgaactgtggaatgagacgagcagaaagtacgagactcttacagatgagggaaaagaaaaactgccgaaattcgtccatgcgattgcaaagctgagaaaggactacaagatgaatttaaaaggaagaagttttttgaaactggaagattatacaccggcagagattgaatatctcgttgacctggcaggtgaattaaaggcaaagaagaaagcaggaattaaaggacacagcctggaaggaaagaacattgctcttatttttgaaaagccatctacaagaaccagatgtgcatttaccgtgggagcacaggatgaaggtggaatcccgacataccttgcaggtaatgagatccagttaggcgataaagagagtatcgaagatacagcacgtgtacttggaagaatgttcgatggaatcgaattccgtggatttgaacagagatacgcagatgtacttgcagagtacagtggagttccggtatggaatggtctgacagatactacacatccgacacaatgtctggctatgctccttaccatgaaagaagaattcggacacctgaaaggtctgaaggttgcataccttggagatggacgtaacaacgttgcgaacagccttttggtaggatgcgccaaaatcggagtagatgtagcaatcgttgcaccgaagccactctggacttcggaatctctgtggaagagatgtgacgaatatgcaaaagaatccggagcaactattgagatcaccgatgaccttgatggtgtaaagggagcagatgtcatttacacagacgtatggatttccatgggtgaagaaaagaaagagcaggaaagagagcgtctcggaaagccatatcaggtaaatgcagctctgatggaacgtacaggaaaagatactacaatcttctcacactgcctgccggcgatcaaagaaaaagaagttaccgaagaagtatttgaaggaccacagtcaagagtatttgatgaagctgagaaccgtctgcatacaatcaaggcagttatggttgcaactttaggagagaacgaataataagcatgaaagcggagatattaaagatgctccggcagagcgatgggtatctgtcggggcagcagctctgtgaccactttcaggtgtccaggactgctgtgtggaaagcaatcaatcagttaaaagaagaaggctatgagattgaagccgtgagaaacaaaggttatcgcattgtggatattccggatcggattaccgcggatgcgataaaaagctgtctggagacaaaatggatggcgaaaaatctggagtattatgacgagatcgattcgactaataaccgggccaaagcacttggcgaggccggaggtgcagatggaactctttttgttgcggagacgcagacggcgggaaaaggaagacgcggcagatgctggcaatcaccggcgggcagcagtatttccatgtcgattctgttaagacctgtgatgaatccgtcagatgcaccgatgttgacacttgtcatggcatatgcggcaacgaaagctttgcgtgaaaagaccgagttggatataggaatcaaatggccgaatgatctagtcgtgagtggaaagaagatcagtgggatactgacggagatgagcgcagagatcgattacatcaatcatgtagtgatcggaatcggaatcaatgtcaatatggagtcctttccggaagatatcgcaaagacagcgacttcattgcggatcgaagcgggcaaagaatttcgcaggtttgagctgatcgctgcgattatggagcattttgaaaaagactacgaagcggtctgcgaggcgggaagtctggagccgatcatggaagattataaccgtctgctggtaaactgtgggcgtcgggtgcgtgtactggaaccggaacatgaatatgatgcactggcactggggattgacaagaccggggaattgcaggtagaatgtgaagacggcagcagaaagtctgtctttgccggagaagtttcggtacgtggaatttatgggtatgtatagaaggagaatttatgtatcaggataagatcgtattatgcggagccaactcttacgaagaaaaattttatatgaatccggattttgataatctgccacagcacatcaaagatgaattgaagatcatgtgtgtgctgtatgtacatgatgttgggggaatccttacacttgtatttgaggagaatggggagctggaatttgaagtgacttctgcagagggagatccgatgtttgacgagatcggaagccgtctgaagatcaaggagattcagacagacgagaagaagcaggagcttctgacacagcttcagctttactacaaagtattttttctgggggaagagattgaatgataaagacactgacgataggaaatgtagagcttccgaaccgttatgtgctggcaccgatggcaggggtaacagacctgccatttcgtctgttatgcaaggaacagggagcagggcttctgtgcatggaaatgatcagtgcaaaggcgctccagtacaagaataagaataccaaggcgctgcttgcgatcgatccaagagaatacccggtatcacttcagcttttcggggaagatccggacatcatttccgagcaggcaaagcggatcgaagaacttccatttcagatcctggatatcaatatgggctgtccggttccaaaggtcgtgcgcaatggagaaggttcggcgttgatgaaggatccgaagcgaatttatgatattgtatataagacagcgagagcgatcaagaaaccggtgacgataaagatccgcaaaggatttgacgatacctgtatcaatgcaccggagattgcgaaggttgcagaagaagcaggtgcagcggcaatcgcagtacatggaaggaccagagaacagtattactccggaaatgcagactgggagattatccgtaaggtgaaagaagcagtgaagattcctgtaatcggaaatggggatgtgacaagcggacagaaggcactggatatgtttgagcagaccggctgtgatggtgtgatgatcggaagaggctgccagggaaatccatggatcttcagggaattactggcatatgaagagaccggatccattccggaaagaccgggcacagaccagatccgggaaacaatgctgcgtcatgcaagactgcagatcgagttcaagggagattatatcggaatccgtgaaatgcgcaagcatgtggcatggtataccaagggaatgcaggggtctgcgaagctcagagatgagatcaatcaggtggaaagttatgaagaactggagaaccttttaatggaaaaaatcggatagacataaaacgtgttctttcgcatgagagaatgcgtttttgcatatattaaaccagcaaagaattgttgacacagccgccggaaatatgtataataatgaaattgtgaaagtagctttaaatgcggataaaatcagtatctgcggcttgaatagaaaatgatttgtcggtaagtaaggagaattataatggaagcaaagaaaacattactcacctatacaggacttaagaaactggaagatgagcttgaaaatttaaaagttgtgaaaagaaaagaagtagcaggaaagatcaaagaagccagagaacagggagacctttcagagaacgctgagtacgatgcagcaaaggacgagcagcgtgatatcgaggcacgtatcgaagaacttgagaaaatcctcaagaatgcagaagttgtagtagaagatgacgtggatcttgataccatcaacatcggatgtacagtagatgtatatgataaagaatttgaagaggaaatcgtatttcagctggtaggttctacagaagcaaacagcctggaaggtaagatttccaatgaatctccggtaggaaaagccctgatcggtaagaaagtcggagacgtagtagcagttgagacacaggcaggagttattgagtacgaagtactgaagatcaatcgttcagtataagatggtatacagcagagagaaggagtgaaaaaagtggcaacacagcagaacaatggacaggaacaggatttgaatcatttaagaaaggtgcgccgtgagaaacttgcagaactgcaggcaaacggacagaatccttttgagatcacaaaatatgacgtaacacatcacagccaggaagtgaaagacaactttgatgaactggaaggaaaacacgttgtactcgcaggacgtatgatgtccaaacgtgtgatgggaaaagcatctttctgtaatgtgcaggatttacagggaaatatccagtcttatgtagcaagagacagtatcggagaagaagaatataaagcattcaagaagatggatatcggtgatattgtaggtcttgaaggagaagtattcaaaacaaagacaggggagatttccattcatgcatctgctgtaaagcttctctcaaagagtctgcagatccttccggagaagttccacggactgacaaatacagatacccgttatcgtcagagatatgtggatctgatcatgaacccggaagtaaaggatacttttattaaacgttccaagatccttaccgcaatccgtaaatatcttggaaatgaaggctttatggaagtagagactccgatgcttgtacagaatgccggaggagcagctgcaagaccgttcgagacacatttcaacgctctgaacgaagacctgaagctccgtatctctctggaactttatctgaagagactgatcgttggtggtctggaaagagtatatgagattggacgtgtattccgtaacgaaggtcttgatacaagacataacccggaattcactctgatggaactttaccaggcatacacagactatcatggcatgatggatctgacagaaaacctgtatcgtttcgttgcacaggaagttcttggaacaacacagatcgtatacaaaggaatcgagatggatctcggtaaaccgtttgaacgtatcacaatggttgatgcggttaagaaatatgcaggtgttgactggaacgaagtagaaactcttgaacaggcaagagaacttgcgaaagcacacaatcttgaatttgaagaaagacataaaaaaggtgatattctgaatctgttcttcgaagaatatgtagaagaacaccttcttcagccgacattcgttatggatcatccggttgagatttcaccacttacaaagaagaaaccggaaaatccggactatgtagaacgtttcgagttcttcatgaacggatgggaaatggcaaatgcatactcagagctgaatgacccgatcgatcagagagaacgtttcaaagcacaggaagaactgcttgcacagggtgatgatgaagccaacacaacagatgaagacttcatgaacgcactggaaattggtatgccgcctacaggtggtatcggattcggtatcgaccgtatgtgtatgctgttgacaggggctgaggcgatcagagatgtgctgctgttcccgacaatgaagtcccagggtgctgcaaagaacgaagcaaataatgcagctcagtctggtgcagcagcaccggcagaggctgaaaaaacagttgagaagattgatttttccaaagtaaaagttgagccattatttgaagaaatggttgatttcgatactttcagcaagtctgatttcagagctgtaaaggtaaaagcatgtgaagcagttaagaaatccaagaagctgttacagttcactctggatgacggaacaggcacagatcgtacgattttaagcggtattcatgcttattacgagccggaagaactggttggaaagaccttaattgcaatcaccaacctgccaccgagagccatgatgggaattgaatcttgtggaatgcttctcagtgcaattcatgaggaagagggcgaagaaaaacttcatcttctgatggttgataaccacattccggctggtgcaaagctgtactaaaattaaatattaaatgtctaaaaccatgatgtcagaccgcatttgacaacaatttgacaacaaaatttgggataataatgaatcgttatgaagcatgacgaatttcaggtgaaaggacacaggtttggcaatgaagtaagagcacttcttagagttaatctaagaggtgcttttttgcgttgcatatcaaagaggcgccagtggcgcgtctgatgattcggccctggaaagttatatcccggcagtcagcttctgtaaaacagcaaatctaattttggaggaaaacatcatgggtaaaagttataaaccaattacaagtatgaaggaagtaccagagcagcttagaaaattacgccgacagtatctgcgttatcaacaggcagagattatttacagcatttctcataagaaactttttgaactcgccagtgatgcaggtgcaatttacagaatagatggaaccgtattgattaaccgggatatttttgatgactatctggagcgttttcatgaaccggcaacaggaaatgataaggagaagaagacggatgagcggtaatgtatggatgttttcagatgaaatcgatgatgaagatctggaatttatgcgccatgattacgtgacctataacatggcgtgcgaatactacagactgggaatcaaacccgttgtccgtatggcacatgaagcaggggcagtatataaaattgggaaaaaggtgttgattcgaagaagtatatttgaagcatatctgagagagaagagaaagatttgatggaggagaagaacatgagcaatcagagaaaaatactacatgatgacaggaatggattagattatgtgttggtaggagattattacctgccagtgctatcattaccggaagaaaccagaccgattgggtactggggaatgcttcgaaaagaatatatgaaaaactataaatcaggtatgtattcttatcttctgttgactgggaaattggacagctatctggcagatctgaatgaacaggcacaggaacggtatgaattgaatgaggcacaaatacgaagtgcggagggagttacagaggaattaaaagcatgtaatcctatggagtgggtgcgacagtgtaataatgtcgagaatcgtgtgcaggaaattgtattgagtgaattggtatatgtataggaggagcgtatgagatacaggattgaatatgctgatggaagatgttgcaatttcgcaaacagcagaaaagatttactggattggttgaaacttctgaaagatgaacagattgttgatatccgtaaaatctataaaagcggtgttacagattcagttctgaatagttaccgaagatatttaaaatagtgaaggggtagatgaagatgttgaagcatatatgagccagcaccgtcatgatacagacatacaggaattgaaaacatattttacaagtgtgatagactggatttctggtgtatttagtgatgtggaaagtgaaatgcgtgggattgagtggggaagattatttgaaacttatcataaccaaccatatgatccggtggaagcaggaagcggcacataaggaagcaccgaaagtaagagaagataaagccagatagatgtgaggacgtgggagaaatcctgcgtccttttttaatgcggataaatatgatagatggtaaatagtgtgttgttattactcggtcaaccgactatgatatatagtgaatattttgtagaagatagaatgtctggtgacagatgaaaagcagcataaagaatagcggtgaaattcaaacaaaggaaccttacatcaaatgtaagtggtgtatttatgctttgtgtagtaaaattttaattgtaaaaaagtatgaacaaaaaagaggtgttaagaatggattatacaaaaaaacttttagaagtacgcgacctgcacaaagcatattccaaagagggcgttcccacaaaagcactaaacggaattacctttgatgttctaagtggcgaatatttgggaattatgggagccagcggttccgggaaaacaacattattaaattgtattgctacggtcattaaacctacctctggacaaattttgctctccggggcgaatataagtgcctttgacggtgctaagttagcggaataccgtggaaatagaattggttatctgtttcaagactttgctttgcttgataatttgacaggcagagaaaatattctgttgcccttatccattcacaatatagatagttccatagccgaaaagcacctaaatgatatagccggatttcttggaattattgatgttgcaggatatgtgagcaggagtatttatcagtgtttccggcttttgccctcagttattattcacatatgaaaggattgaaaatcgaactcggctcagacagagttttagggataccgcttgatacttatattccatctgaacaggtggcgattgaagtgaacagcggttcagaagatatggaaatcttaaaagaacatctctgtcagcaaagaggaattaaacggatcaagttgcctatgaaaaccaatgaaacagaaatcgcttatgctcagcgtatcaaagcagcctttcaaagtgtacatatatttattacttccgatacggaagaagatgtcgggactatcagaaacgtatttgagaactggagaaacagccaatgagagaaaagaaatatcatatttacttaacagccgaagaacagagcagagttattcagtcacttatccggctgaaaaatgagcttctcgaacaaggcagatatactgacgcagtggatgatgttctctgcaaggtattggcagccaagaagaagcataatttattcatctaatcaaattgcccagaatataagaggaccgcctacaccgaagtgcaagcggtcttttttgtaaacctgttcgtctgcctatttattaccgtcagcggtgtggtaatatcacaaaccagaatctggtatgtacttgtttctgcaatccctatgcgaatgatgtgcccgttgcttcatgttttaccaaatggacttgccgcagaagcagggaatcctcttttggatacgggagtcattgttccgggaatgtgtctctcaatcatctggtttgtttttgtaacggttctgtttttgaaatggtttgagagaagagaggtgaaataagatgattggaagatctcttaatgcagacttgcgaaagatgaaaggaacatctgtgattctggcacacttactgattccgattataaccagcgttatatttttaatatattactttttttcaccatggaatgaaaatatgaaagtgattgcattttatcaggcaataggagcaggacttccggtacttattggaatttttacagcaagtgtgatggaacaggaacaaaatgcaggtgattttcaaaatctgttgtctttaccggataaacctgcagcatttttatcgaaactgttgatgctactggttttgtgtctgtgctctatcctattgacagcaatcatattcggaattggatttggaagaatcgcatcaagcgatatcgaaatcatgaaaggatgtatatttgcagcattgctgctgtggggaagcagtgttccactttatctgtggcagctgattctggcttttcagtttggaaaaggggtatccattggagcagggattatatcaggactaattagtgcattgatgcttaccggacttggagattatgtgtggaaatatgtatttgtctgctggacgggtagagtaccatatacttatctgcaatctgtattgggagaaactagtgtaggtgaatggttgtcattcataccaggttgcttaatatttacagggattagtatggtatactatttttggtgggtaaaccactgggaaggaaatagaatatcggaatagaatcgagggaaactatggcaaaaatactggcagttgatgatgaaccggcaattctggaaatgatagaaagcattttgaataaggatggacatctggttaccaaagtaagtaatccactgaaacttaatatggaagaattacatcgttatgacctgattttactggacattatgatgcctggaattgatggcttcgaattatgcaaaagaatcagggcacttgtggattgtccgattttgtttcttacggcaaaaacggaggaaaacagtctggtaaacggactttctttaggagcagatgattatatttcaaagccatttggagtgatggaacttcgggcaaggatcaatgcacatcttagaagagagcacagggaacattctgtccggatggttttggggagggtctgtattcaaatatctcaaaagaaactattggttgatgataaggaacttcctcttacgaaagcggagtacgaaatctgtgaatttctggctaaaaacagaggacaggttttctcgaaggaacagattttagaagaggtctttggttttgacagtgagagtaatgacagtaccattatcacgcatatcaaaaatataagagcaaaatttgcggattatgattatacaccgataaaaacagtctgggggattggatataaatgggaagagtaaagagaagcaatgcacttagctggatttttatgagatatgtactggtcatgcttggatcattagtaggtttggtgattgttgcttggctgctgctgtaccttttgattagtgtgggctgtatctatccggcgaattatgcagagcaaaagattaatgaagcatatgatacgattttacgtgcggataaagtaactgctgagatgattcctgcactttgtgattatgtaatcttttcagagaatggagagaaaataggtggagatctgtcagaacaatacgaacagatagcatggaatgttgcaaagtacggaaacgcatccgggaaatatttttataaagtaattgtaagggaaaatgaatatgttgtattgcaatatcgcctgacacctcaatatcattcagcttttttgagggagcattttataggaccacagaatgtgatgagtattatgtcagtgattggagcggtagcgattatcatcattccgtccatacgttttggaaaaagaatcaaaaagcagatgcagcctgtattagacgcaatcagacaaataaaggatcaaaatctggaatatgagacatcctgttctggtatcaaagagtttgatgactgtttatcggcaatcgatgatatgcgagatgcattgcgagaatctttagaaaagcagtggaaaacagagcaggaaaagaaacaacagatgtctgctttggcgcatgatattaaaacacctcttacgattgtacggggaaatgcagaactactttcagagactgaactgaccacagaacagaagaataatatcacttatgttttgaacggcacaacacagatacaaagttatgtaaaacagttgatagatgtcacaaaatcatggaattgcagtgatgttacctatacaacggtgaggttagaagattttttcgcagatataaaggaacaggcactcggactggtagaaatctatcaccagaaaatagattggaaggcgggacaaagtgataaaaaggtaacgattgcttatgatccaatgttccgggccgtaatgaatatgattcagaatgcagtggagcatacaaaagaaaatggaatcatttatattgacgcaaaggagcaggatggccggctgacattcattgtggaggatagcggatcaggatttacaaaagaagcattattgcatggcacagagcagttttttatggatgacacaagtagaaatggcgaagtccattatgggatgggactattttttgcaaaaactgtggctgaaaaatatggtggaggtattaaactttcaaattctgaaaatacaggtggggcgagggtagaaatatttttcctgagtagtcaagaaacaagctaaatagaccgcaattaagctatgtaaaagaaattttacatgcttttatctaatatgtaaaagccttttgatagacattactactacgtttgctgtaatctcatggaagaaggaggcatacagaattatgatagctgataaaattaaaaatgctcgtactattctttattacataactatcattatagttgttctcaagtgtggagaagcgtgaaaagcagatgaagatggattcagcggtggatgatatacgcagaagatttggattttacagtatccagagagggctcatgtaccgggacaggattctgtcggcagtcaatgcaaaagaagaacacacagtacagttgttacggacacactgatcacgggaaagaaacgggtgcggatttattattaagtgcttttgagatattgataaaatatgtgaagaaaaataagcagataaatggatttaatataaaaatcggaagttggaggatacaagcatgaaaattgtaatcattaatggaagtgccagaaaaggaaacacgctgacagcaatcaatgcatttataaaaggagcatcagaaaagaatgaaattgaaatcattgaacctgacaaactcaacattgcaccatgcaagggatgtggtgtctgtcaatgctctaagggatgcgtcgataaggatgatacaaatcctacaattgataaaattgctgccgcagatatgattctttttgctacaccagtttattggtggggaatgtcagcacaattgaaacttatcattgataagtgctactgccgtggattgcagttaaaaaataaaaaagttggcacgattgttgtaggcggttctcccgtagacagtatccagtatgagctgattgataagcagtttgactgtatggcaaaatatctttcatgggatatgcttttcaaaaaatcatattacgcaacagccagagatgaacttgaaaaaaacaaggattccatgaacgaacttgaggggatcggaaaaaatttataaagcacgttccaaattccagtttgccaacttgccctttgagagagtccagctaataaatgtcaataattaaatgagaaaaaaatattttgttttctgactaaaaaagggcagactttcctcagcttccaccggaagtaatacatctgcgggcaataattccgggaacagcagttcagcggggaataacagttcttctggcaataataatccttctaacaacaattcatcgaataatactagttccgattcttccaattccggaagcggtggctatgtgatcccatcaggcggtcttaccccgtcaaagggaaggatctggtataatggacataccgagacttactattctcagaaggtacttccgggaggagggcttgcgatcccaggacgccatatagcaagtgacggaacaatcagggatgccgatggttacattgttttggcaagtgatgattacccgagaggaacagttgtagagacgtcacttggtgctggaaaagtatatgataccggaagtggatccggaaatatagatctgtatacagattggtaaaagaaaagcgagacagtaaaggacaaaccttttactgccccgcttttgaatttaatgggatatgtattttcagtgaatcgaaaaggcatattttgctttgtactggagaagttcggttactgtgtttcgtaggttgccttagcgtcacgtatcagcttgtcgaatttatctgcatcccatgcagcacgtcctgtaaagagtccatgcagaagaaacagaaaggtatttactcaccggaaggatgggctcactacaaagttacaggtgaagctgcaccggaagaataaaaatgttataatttgtttatggaatgaagtcctcttgtgtgttacaatacaagaggacttttgttttatagagaatagttgtcgaacgaaagggtgaaaactattaaagaaaggaaagtggaagagaaaattacagttcggatgacagatacatacctgtttgactttacgttatatcatacctattcgaaactggcaggttttctaacaaatattctggtagcagcgattgcttttatgggaatcatcatgctggttatgggaaagataaaacccgtgcagattattttttatctggtagcagcggttgtgacgaattcgctcctggtaggaaatgaacttgcagcagtaagacatgtagaactgtatatgatcggtggtcatgtgggcggtcatctggcagcgacgatgggagatgcagccattgagaatatggaaaaatttcatgtagataaaggatttatcggagtacacagtatcaattttgatgtgggtctgacatccatcgcaacaccacagatgcaggtgaagagagcgatattcgaagcatcccagcaggtgtttgttcttgctgacagcagcaaattcggaggcgggtatgtgtccgtgatctgtccggttaaggatgtatacaagatcattacggattcgcagatcagcaaagagtatatccgaaaagcggagcatgaacagattccacttgtgatagccggaaaccgggagcaataatatgatatatgagagaatacaaaaggggcgctttttaaagcgccctaatcgatttatagcaaaaatagaaataaatggaaaagaagaaacggtccatgtgaagaacacagggaggtgcgcggaacttctggttccgggagcagaagtgtttgtccggaagtctgaaagtgcagggcgtaagactggctgggacctgatcagtgtcaggaaggctgaccggctgatcaatatggattcccaggtgacaaacaaagtggtgcaggaatggattgaagccgggagatggttcaaggacgtgaagatcgtcagaccggaagttacctataagaattccaggtttgacctgtatgtggaatatgaagagaaaaaagcgtttatagaagtgaaaggggttacgctggaagaagaaggcgtggtaaagtttccggatgcaccgagcgagcgggcagtgaagcatttaaaagagctggaagaagcggtgcaggatgggtacgaggcttatgtattctttgtggtccagatgaaaggagtacgttattttacaccaaacagacggactcacaaagaatttgcagatgttcttgcagacgcagcggaaaccggggttcaggtgatcgcaaaggactgttttgtaacggaggattccattgcaattgcggacgaagttccggtagtacttaccaatccacagctctatgaagcaccggagctgcttgtggaatggtacagagagcggaaacgggatctgccatggagacatcatgtaaatgcctatcgggtatgggtgtctgaaattatgctacagcagacgagagtggaagcagtaaagccattttttgagcgttttatgacagagcttccaacggtaaaagatctagccgaggcaccggaggataagcttttaaagctctgggaagggcttggatattataaccgggtacgcaatatgcaaaaagcagcgcagaagatcgaggaagaatacgcaggaaaatttccggaaaattatgaggagatcaaggcgcttccaggaattggaaattatacggcaggggcaatttcttcttttgcctatggaattccaaagccggcagtggacggaaatgttctccgggtggtatcaagactgctggcgagcgatgaagatattatgaaagcgtccgtcagaacaaagatagaaaatgcgattgaaccggtgatcccggaagatgcagcatcggattttaaccaggggctgatcgaacttggtgcgattgtctgtgtgccgaatggggaggcaaagtgtgaaatctgtcctcttacgggaatctgtgaagcgaaaaggcttggaatccagaatgaactgccggtgaagaaaaaggcaaaagcgcgcaggattgaggagagaaccgttttgatttttaaggatggtgatcatgtggcaatccggaaacgaccggataagggactgcttgcaggtatgtatgagttcccgaatctggtcggaaagcttacgatggacgaagtaaccgcttacagtaaatctatcgggcttgcaccgattcgtgtgaaaaagctgcggaatgcgaagcatattttcagtcatattgaatggcatatgactgcgtatgaggtgatcgtggatgaactggagaagaactgcaaagaagagatgatctttgcacatccggaagaaatacaaaaggaatattccatgccatcggcgtttagcgcatggaaggtgaaataaaagaaggacattgcttttcgattttgcgaaatgcgatgtcctttctttggatcaaagaaaataattataagtgtttaaatcacctgacgtgcaagccgtggtgactttgcaccttcctgtgcataaattagtgagtacatgaaatatgccatcacacatgcagcaactacatccactacggaatgttgcttcaggaacatggttgacagaatgatcagaatgcttaaaacaagagatcctttctggatcagtctggagtgctgaagcttctcgcaatgggaaattgcgatgtaacaacaaatagagttgtatacatgaagacttggaagcacattcgtaggtgtatccgtctgatagatccgtttaaccagctcgatacagaagttatcacgcgtaaatacttccggtctcaggttcaatccgttcggaaataccgtgcagatgatcagaaaaatggtcataccgctgaacatgatcgcggaggctttgtaaaatccctgtttatcattaaagaacaaatatcccagtgtgactgcaatataagcaaaccacagcaggtacggaatgatgaaatattcacaaaacgggatgtagtcatcgaatatcgaatggattacaaaataattgtcggtcacatggcgttccagataagtaaaccatggaaaataaataaaagcatatagtaatacccatgcatggctgtatgtatgcatcagtgtctttaattttttaaaaatatgactcatgataaaaatcagctccttcgggtgaagatgtttcttccttgttactagaggtagtataacattaaaaatttttctcgacaacagacttcataaaacattcatatttttttctattctctattttacggagaaaccttcaaagatatacatatcatatttattccgtgcagttttataagctttttgattgcggagtgtccagactgccatcggaatacggtacagatagtggttcagccagacggaaggattgccggcatctgcaagtttataagaaataaagtccggacgacagatcaggttggtcagcaggaactgtacacaaaagcgcgccagaaaaggattttccggattcgtgcgagtcagggcagaagaaagctgtccacgaagaacctgaggcgcatgcttgtgaaaccatcggattccaagggagttgaaagactggatcatataaggtcctttataatcctttaaaatatcccatgcggcagggcagagcttcatattgctgtccggaagcttcagttcaatcagaagaggaacccgcccattgacatagcgaaggacatctgaaaaaagtggcatatgctccgaagttccggaaagatgcaggtgctgtagcgtatcaaacgtggaatcctcaactgtccctccggcattgcagatccgctttaaagactcgtcatggaatacgactacttttccatcacgggtgagatggatatcaagttcgatggcaagattttgttttactgcctcacgaaatgccggcatagaattctcgggaatcagccgggaagaatcatgtagtccgcgatgggcataatcccacttgagataagggaggattttgcttcggcgggaagtattcggcatgatcatatataaatataagaaaaaacatacaacaacagttaaaagaatccaaaacaacagcatagaaaagtccccttcttttatgtaataattttcagtgtctcaggttcgagagagaacaaaacatccttctggagataaatcggttcgccgtcagaatgtaccggaagtgctacttttgagtgtacttctgcttttttacagcggaagatatgtacgcctggaagtcgggtatgctttccggaaaacacagtcggcagaattgccagagcaataattttgggaacatttgcaatcacaataaagtccagcagatcatcatccggtttggcatccgggcagaatttgcatccaccaccttcataaggaagattaaatgcagaggcaaagaaaacccgtttaaaatgaagtcttttggtatcgtccagaaggatttccatctcatctggctgacagcggcgcagacggtagagtgagcaggctgcataggcaagtttgcccagaccgagccggttaaaaaagactttaaccctggaaatacaaagttgatggcagatagctgcatcgtatccgattccggaactgacggcaaaacggtgaaccttgtcatgatagtgcaatacaccaagattgatcttgcgcgtctgttcagaatgaagtaccagatccagagctttcatggtatcggatggaagggcaagtccccggccaaaatcattgccagagccgatcggaatgtaaccgagggtaaccaggcttaaattctgcagaccacagattacttcatccacacttccatcaccaccaagtacaacgatcgtaacaggatccccggaggcggtaagctcggcggcaatttccgttgcgtgatgccggtgatgtgtaaaatggatctggtaatctatatgttctgctatcagctttaatttaatcttttcccatagtgcaagtccctgacccgagcgggcgttaggattggctataaaatgatacataaagtcatcccttcacttctgtaaatttagtttcattctagcatcggaatgagaggatattgtcaaaaaaacaataaaaatgcaaaaatttattgaggcagagtgttaaaagtgctattctggtacatgtgttaaaaaatgaacataaaataaatggaggtaatactgtgaaatttataagacaattcttgattatcatattgatttcttttgcaggagagcttttgcatgcaatccttccactaccggttcctgcaagtatttatggcttgctgatcttgctggcaggtttgcagacaaaagtaattcctttgaaagcagttgatgaggccggtggatttctgattgaaatcatgccgatgctttttatccctgcaggagtaggtctgatggtatcatggggaggcttaaaaccggttcttgttccgatcatgattacaattgtagtgacaacagtgctggttatgggcgtgagtggaagaaccgctcagtttgtactgaagaaagaggagaagaaggatgagtaatatgctgcatggatcgacctttttttgtatggcgatcagtctttttggatatgaggcaggaatttttttgcgtaagaagttaaaaattggtatcttcaatccacttcttgtttcgattgtttttgtaattatcgtgctaaaagtgactggaattgattatgatacttatgataagggagcgaatgtactgagttaccttctgacaccgtctacagtctgtcttgcaattccgctttatcagcagatgaatcttcttaagaagaatctgaaagcgatcattgcaggaattataacaggtgtatttgccagccttgccggtgtatgggtattttctatgttgttccacctgaagaagcagttctatgtaacgcttcttccaaaatcaattaccacagcgatcggtatgggaatctcagaagagcttggtggaattgtgacgattacagttgctgcgatcgtaattaccgggattattggaaatatgtttgcagagggaatctgtaagctctgcaaaattgagcatccgattgcaaaaggactggcaatcggaacagcttcccatgctatgggaacggcaaaggcaatggaaatcggagagattgaaggagcaatgagcagtctttctattgcagtggccggattgatgacggttgtaggtgcatcgattttctatcacctgtattagagaggagtgtgcaaaatatggagaaaacaattatctgtatcggacgggaatatggaagcggcggacatgaaatcggtgaattgctggcaaagcgtaccggttatgcgttttacgataaagagaagctgtttgaaattgcaaagatgcgcggatacgagaaagaaatgcaggagtatctggatgaacagccggtggacagccttctttattcaatcgcaatgaattttgcagaaccgaagaagaagccatatccatttaagctgattgaagagcttgcggaagaaggaccatgtattattatgggaaggtgcgcaggttatctgatgagaaaccgagaagaagcttttagtgtatttgtccatgcagacatggaaacacgaattgaacgcgtgaaagagcgtgatcatattacaagcagaatgaaagcgaaacgtaagatccaggatgtggatgagaaaagaagcgcttttcgtaaggattataccggacaggaatggggaatgtcgaagaattatgatctttcggtcagcactacagagttgtcctatgaacaggcagtagatctgattctgtattataagaagatgacagaagaatctgacagagcttagaaggtataaaaagaatatactagtttgttgaatccagaaatgggaaatgacatggcaggtcatttcccatttctggattttagagatatagaagggctcaatttctatatcttagtttatagaatacgtggcttctataaattatttatatattcgttacaatcttttagagggcaaaatttgatttatctaggcatctcccatgcgttatgatccgtgtgaagcaacatatgtgacttgtgagaaagcggtttctcaaagaaatcacggtacagacggagtacatccgggttctcatgtgagaagcgaagtggtgcattcttatcaaggaaataaagattttcaccacgtgcccgtgcaagttcttctccgtcatggattggttgaccgccaccgccgacgcatccgccagggcaggccatgacttctacaaaatcataatgtacttcaccatgttcgattgcttcgatcagtttacgtgtgtttccgagtccgctgacaacagcagcacgaacagtagcatctccaagctgaatctcagcttctacaacacctggctgtccaccaggattgcggacaatcttgaatgcatccggatcagggttacgtccggttacaaggtagtgagcagaacgaagcgctgcttccataacaccacctgttgttccgaagataacaccggcaccggtccattctttcatcagaggatcgcattcacgatcaaccaaagaagcaggatcaatatgtgcagaacggatcatgcgtgtcaattcacgagttgtaagtacaacgtctgtctcgtgtccggcatattcaccatagaacagttccatgttactttcgccttttttggcaacacatggcatgatagatacagtaaacatattttccggtttcacaccgatggattctgcaaaatagctcttcataacagaaccgaacatctgctgtggtgacttggctgttgaaagctgtggcaccagatgtgggtactgtgatttaaggaagcgtacccatccagggcagcaggaggtaaacatcggacgaagatttaattcgccttttgtaaatctctgcaggaattcatttccttcttccataatagtaaggtctgctgtgaaggaggtatcgaatacatagtcaatacccattttcttcagagcatccatgatcttgccgacagttgcttcttcacgggaaagaccaagagcttcaccccatgcagcacgtacagcaggagcaacctgtgcaacaacgactttcttgtcatcagcgattgcatcccatactttctctgtatcatcacgttcgcgcagagcgccgaccgggcagtgagtaatacactgaccgcacagagaacaggaaacctcggagatcttatggttgccggttacattaatggtagtacgggaaccagtacttgtcacatcccagatatgtaaatcctggatcttgtcacagacctggatacagcgcatacatttgatgcatttctgtgagtctctgatcagcggaaattctttatcccaagggaattcttccagacgctgcttaaatggtatttcgatgatgttcaggtcatttgcaagactctgcagagtacagttaccgcttctgacacaggtagcacatttgcagtcgtgctgggaaaggataagctgtacagtctgtcttctggctgtacgaacctttgggctgtttgtatggattaccataccttcttttactacgttgttgcaggaagttaccagccgttccattccctcgagttcaacaacacagacacgacaggctgcgatctcgttgatatctttcagatagcagagctttggaatcgggatatccgccattttggcagcatccatgatagtagtaccttccgggacagatacgtttatattatcaattgtaagatttaccataatgtttcacgacctcctttgaaaatgccgtagccgaagtggtcgcaacgcagacatctgctggcttcctgtttcgcttctgcctcggacatgcagttttctacaccgttaaagtcacagacacgttcgcaggcttcacgctcggtcatgtttactcttccgcacggcgggcggtcatcaagacgcgcttcaggaatctcaacgtcacagctgataatgtggtgatatcccaggtattcgtctatgttagcagctactacttttgcagcagcaatagctttgattacggatgcaggaccggaagcacagtctccgccggcaaatacacccggaatgttatcgaatccgccgtatttttcggttaagatcttacctctctgtacaggaacaccggcttcttcaaagtgctggtattcaatatcctggccgattgcaacgatcagtgtctggcatggaataaatacgtcaggagcacctgtcggacgtacacttgcacgaccgtctttgatcttactgatcatctgtggtgtaacgtagattccttttacatgaccgttttcatctgtttcgatgcgggaaggagccatcagagtctgtacttcgattccttctgcaacagcaccttcaatctctgccggaagggcagtcatatctgccacgcggcggcggtaaacgatgctgacttttttagcccccagacgttttgcggtacggacagcatccatagatacgttaccgccaccgataacggctacttcctgtccggtaagatccgggttctggttctttcctacatcacgaaggaactgaacagcagaaaggacaccttctgagtgttcgccttcgataccaagtttcttatcggtacttgcaccgattgtaataagaactgcgtcgtattcttcacgcagactctggattgtcatatcttttccaatccgtttgccaaattcaactttgacaccggtctcaaggatggcattgatatcatcgttcagacggtctttcggcagacggtagttcgggataccatagcggagcataccgccaagttccggcagcatctcaaatacggttgtctggtgtcccatcagctgcagatagtaagctgcacttaatccaccagggccaccaccaacaacggcaatgcgctttccggtagatggagcacatggcggcggtggaacttttccggcataatcagcagccattctcttaagaccgcggatattgactgcatcgtctacgatgttacgacggcaacgtgcctcacaaggatgttcgcagataaaaccacaggtggtcgggaatggattgtccttacggatcaggcggatcgcatctgcgtaacgtccttctccgacaagagcgatatatcccggaatatctacatgtgccgggcacaaagatacacaaggaacaggctgtgtgtactggcaggtacatcttccctggcgcacatgttcttcatagtcttcccgacatcccatcagactcttgtaaaccatgtgagctgcttcatacccgatcgcacagtcagctccttccatgattgatacagagagttcttccatcaggtctaatgtttccatagttgcgtctccgttcataacgtcggtcagcaggtttttcagctgccacagaccaacacggcacggcacacattttccacaggtatgtgtatgacacatctccaggaaagcacgagtcatgtcaacaggacatagtcccggaggactggattcgattcttcgctccagatctttgtagagcccttcgataaccagctgggctttgtctggtgcagtgatttcaagtctactcatagcttttttctcctttaactttttttgctaatctacaggacagatgaagaaaatcatagggaaaacatctgaatactatagattaactctatggacacacttataatgatattgtatgcattttagtacaatcttgcaagcaaagttaataaatagacaaataagttaattttgtcacaaaatgataaaaaatatcagcaatatgtacaaaatggcagaacaacgataaagggtgcaaaaaataaaaaaattatgttacaataacacctgtaaaagagatgtctgttttacaggcacaattaacagaaagggcggaagaggaaaaatgaaagtaacagattttggtgcaacagttaaaggtgacgagacaaaattatatacgctcacaaataaaaacggaatggagattgcagtatccgattacggtgcaacgctggtacaggtgatcgtaccggacaaagaaggcaagccgtgtgatgttgtgcttggatatgatgaggcagcaggatatgaagaaggagatctgttcttcggtgcaattgtcgggagaagtgcaaaccgtatcggaggagcatcctttgaactgaacggagtgacctatcagcttgaaaagaatgataatggcaataatctccacagcggaatggatttttataaccagagaatgtggaaggtaaaagaaaccgcagatgatcatattacatttgaactggacagcccggatggtgatcagggatatccgggagctgtacatattgaggtaacatatactctgacagaagacaatgcagtgaagatcgcttaccatgcagttccggatgcagatactctgatcaatatgacaaatcacagctattttaatatggatggacatgcatcaggagatgtactggatcaggaagtatggattgatgcagatgcatttaccagagccgatgccgagtctattccgacaggcgagatcacaccggtagaaggaacaccgatggatttccgcacaaagaaagcaattggcaaagaaattgagacagattatgaagcactgaatttcgggaaaggatatgatcataactgggttctgaacaataaaggagaatttgcgaaagtggcagagatgtcctcggaagagagcggaatcactatggaagtttatacagaccttccgggaatgcagctttatacaggcaactttattgttgatgccaaaggaaaaggcggggcgcattaccacaaacgccaggcagcctgcttcgagacacagttcttcccggatgcaatccataaagagaattttgccgggccggtatgcgagaagggcgaaacttacgaaacaacaacgatgtacaagtttatataacaacagataagccgaaaaggtgccatggacataaaaatccatgacaccttttttgaaaatatgtgctgtaaaaaatcagcgaaggaatatgaaaaattcattttacgctgtggtatatctgtgaaatcagaaaatgccatccagataatgcccgatcgaacggcggatattaccttcaaaatcagtctctccgttatgcagacaccattcaaatacatttccgataaccagcatacggatatcagtgcagatttcatccagggaaatctttggcgcaatgatgccggcatcaatcgctttgcgaagataattctctacggtaaggatcgggtacggtcgctcggtacggatcgttgggttcagtgcctggttgcgcggtgtgtagtagttggacatgaattctactccgagttcccggcagtactgtgcgtaattcagataaacgtggatgataccgatctttgcctcatctgcatcttccggcgtatccagaagatccggattgatgcttggctgttcttcaatataataagataaaagatcatctttggttttaaaatgatgatagaagctgccgttggagacacctgcttcatcacagatattttttatggaaagctgatcgtatccctgcttctgcagaattgtcttggctgcatgaaagatacgtgctttggtttcttttgattttttctgttgtctggacagtggctctttttcaatatcgcttgacatttggttaatcctttcttaaaatttttcagtcagattagctgtagtatagcatatttaatagaaaaagacaagaaaaccgagcgaactctgtaattttaacgggaattgaaaaataagagatgacatggtatcattaaatccatagcgaacaaaaagagaggattggatatcaatggatattaaccagaaaataacagaagaactgggcgtaaaaaagtggcaggtagatgcggctgtaaagctgattgatgaaggaaataccattccgtttattgcgcgttacagaaaagaagcacacggtacactggatgatgaacagcttcgtaaattatatgaacgactgacctatctgcggaacctggaagagaaaaaagaacaggttcttgcaagtattgaagaacagggcaagttaacacctgagctgaaagcacagatcgtggcagcagagacgcaggttctggtggacgatctttatcgtccgtatagaccaaaacgccggacccgtgcgacaattgcaaaagaaaaaggtctggaatcactggcggttctgatctctcttcagaatagtaaggagcccctggaaaaagaggcagaaaaatatgtttctgaagaaaagggcgtgaaaaatgtgcaggaagcgattgacggtgcgaaagatattcttgcagaaaatatttcagatgaggcagattacagaaagaggatccgcgatctgacgttcaaaaagggtacgctggtttctgctgcaaaagacgaaaaagcagaatctgtatacgagatgtattatgattttacagaagcggtcagcaaagtagccggacaccgtgtgctggcactcaaccgtggagaaaaagaaaaattcctgagtgttaagattgaagcaccggaagaggaaattctccgttatctggaaaagaaagtgatccgcagggataatccatacacaacaccggttttgaaagaggttgtggccgacagctatcagaggctgatcgcaccggcgatcgagcgtgaactgagaaacgaactgacggaaaaagcagaagatggcgcaatccttgtgtttggaaagaatctggagcagcttctgatgcagccgccgatcgtcggacaggttgtgcttggatgggatcctgcattccgtaccggatgcaagcttgctgtggtagatccgaccgggaaagtaatcggcacgactgtaatttatccgacagcgcctacgactccgaagaagatccaggcagcaaaagatctgctgaaaaagattattccaaagtatcacatctctttgatttccctgggaaatggaacagcatccagagaatcagaacagtttattgtagaactgttaaaagagattccggaaaaagtgcagtatgtgatcgtaaatgaagcgggagcatctgtgtactcagcaagtaaacttgctacagaagaattcccaaaatttgatgtcgggcagagaagcgcgacatccatcgcaagacgtcttcaggatccgcttgccgaactggtaaagatcgatccgcagtcgatcggtgtcgggcagtatcagcatgatatgaaccagaaaaaattaggagaagcacttggcggtgtggtagaagactgtgtaaataaagtcggtgtggacctaaatactgcatcggctccgctgctttcttatatttccggtatttccggaacccttgcgaaaaatattgttgcctacagggaagaaaatggaaaatttgagaatagaaaagaacttctcaaagtaccaaaacttggaccaaaagcatttgagcagtgtgccgggtttatgaggatccagggcggaaccaatccacttgacggaaccagtgtacatccggagtcttacgaggcggcaggaaagcttcttgaaaagcagggcttcaagccggaagatattgcaggcggcaaacttgcaggtctgtctcttaccatcaaagattacaaaaagctcgctgaagaacttggaataggagagatcacccttcgggatattgtcaaagagctggaaaaaccggcgcgtgatccacgagatgagatgccgaaaccaattctcaggacggatgtccttgatatgaaggatctgaaggaaggaatgattctgaaaggaaccgtgcgaaatgtcattgactttggtgtatttgtcgatattggagtgcatcaggacggattggtgcacatttcccagatcacggatcgttttatcaagcatccactggaagcagtcagcgtaggagatgttgtagatgtaaaggtgatgagcgttgatttacagaagaagcggatccagcttacaatgagaggaattcagtaatacatgttcggatatgtgacggcgaatgagccggaattaaaagtaaaagattatcataaatataaagcgtattactgtggcctttgtcagtcactgaagagacagtatggcagcgcaggtcagcttacgcttgcctatgatatgacatttgtgatcattttacttacttctttatatgaaagtgaaacaaaggcagaaagccatcgctgtaagatgcatccgttaaggccacagccaatgctggaaaatgagatcacagagtatgcggccgatatgaatctgatcatggcgtattatcatctggaagatgattggaaggatgagaagaaagtagcagggcttctcgggagtatggccttgaagcgaaaagtagaaaaagcaattcggaaatatccaaggcagagtcgtgtgatcagagaagaaatggcaaagctttcggaatatgaaagtcagggtatacaggaagttgactatccggcaggctgttttggccggctgatggaagagatgatggtatataaagaagactgctgggaacagcagcttcgagggatcggtttctatctgggcaaatatatttacattatggatgcttacgaagatctggataaggacctggaaaaaggaacttataatccattaaaaaagatgcatgaagaagccggatatgaagaaagatgcagagacattctgtgcatgatgatcggcgaatgcgcaagaaattttgaaattctgccatgtgtactggacgtggatatcctgcggaatatcctgtatgatggcgtatggaaacattacagaaagatacaagaaaagaaaagcgaggaaaaggaagatgacaaagaatccttatgaggtgcttggcgtatcaccaaatgcgtcggaagaggagataaaaaaggcgtacagagaactgagccggaaatatcatccggatgccaatgtggataatccgcttcgggatcttgctgaagaaaagttcaaagaagtacaggaagcttatgatgaaattatgaaagagcgggcgaatggaggatataattacggatatggcgcgggttcagggaactattcttatggtaataattcctatgggaatcaatcttatggcaatggcagatatcagcagtacaataatatgaatccggagatgcaggcggcattcaattttatcaataaccgtagatatcaggacgcgatcaatgtgttgaaccgtatgaatgaccggactgcacaatggtattatgcaagttccatggccaacgccggcgtaggcaacaatgtgctggcaagggattatgctgcgcaggcagtgaatatggacccgaataacccgcagtacagagagctgatgaaccagctgaactggggagcacagagatataatagtaatccgtttggtcagggatatggcaatcgtaattcctctccgtgtggaactggaaatatgtgctgtgatctgtggatcgcagattcattatgtgaatgtatgggaggagatctgtgtccatgcatctaaatacaaaaaagattgcatttgcaggcgttatgcttgcactgacagaagtggggattgcgcttggcagtgtgatcgaaacgaataccctttttttactggcggcggcgtccttctttgtcgggattgtgattcaggaatttggattgaaaagcggggcaggctttttactggctggaattttgctggcaatccttctgtctccgaataaattatatgtggtttcctatgcatttatgggattttatattctaattatagaaacaatatggcatttttctggaagagcttccggatggatcagaagccgtaactttttctggctcatgaaatatctggtatttaatgtactttatattccgggtttaatatatttctggagtatgttatctgaaaaaaagaccgcaaaaggaataatgcttatgtctgttgtattcggacaatttatactttttgtctttgataagacatatgaatatgcaatggggaaaatctggaaagaaaatagacataaattcggattttaaagcatatataatacaataatgatgatgtgagtgtcgaaagtaaattttgctgctcactgatgtaaccggattgttctattgctacgcaattcccataatcctcgaacacatcataataataaaaatataaattttatgtattttttgcacaaaaaagtggaaaatttaacagaaaaattgtataatataagacaggacaaataggaaagagaggattcacttatgaagcagaataatatgcttgctatgatcttggcgggcggacgaggaagtcgtcttcacgagcttacaaataaagtagccaaacctgcggtttcatatggtgggaaatacagaatcattgattttccacttagcaactgtgccaacagcggaattgataatgtaggagtcctgacacagtatgagtctattttacttaacagttatgtagcggcaggccgcagatgggggttagatgcccagaacagtggagtctatgtacttccaccgcgtgaaaaagcggatgcggatctggatgtatacagaggaacagcagatgcaatttcacagaacattgattttgtggacatgtttgcaccagaatatgtactgattctttccggtgaccatatttataagatgaattatgataatatgcttgattatcataaagagactggagcagatgcaacaatcgcggtcattgaggttccgatgaaggaagcaagccgtttcggtattatgaatacggacgatgagggaagaattgtagagtttgaagagaaaccggagaatccaaagagcaatctggcatccatgggtatttacatattcaactggaagcttttaagaaagatgctccttgcagatatgaaaaatcaggattccaatcatgatttcggaaaagatatcattccgactatgctgaatgatggaagaaagctctatgcatacaagttcaaaggatattggaaagatgtcggaacaattgattccctgtgggaagcaaatatggatctgatcaatagtaaaaatgaacttgatctgaatgatgattcatggaagatttacacagaggatacaactgtgcttcctcagtatgttggcccgacagcagagattgaaagagcatttatcaaccagggatgtgtgatcaatggaaaagtcaaaaattctgtattgtttacaggtgcaagagtcggcgaaggtgcacagattattgacagtgtactgatgccgggcgttgaagtagaagaaggtgcagttgtaacaagagcgcttgtggctgatggcgtaaagattggcaaaaatgcagttgtcggatcagcagacagtgaacatattgaattagtatcaaaacgtgttaagggggatgagtaatatggcacaggcatttggaatcgtaagttttgccggcaacaatatccgggtaggagagatgcagaattaccgtccggttggtgctgtttcattccttggaagatacagagttatcgatttcccaatctctaatatgagcaacagtgaaatcgaacatattcaggtttatgtaagaagaaaaccacgttctcttacagaacatcttggaacaggccgtcattacaatatcaactcaaagagtggccgtcttcatattctttattctgattttgcaaatgcagaatggagtgtatacaataatgacctggcggcatatgaagaaaatatggagtgtattgaagctgtaaaatatccatatgtagttattgcaccaagttatatgatttatacacagaattatgatgaattacttaagacacatattgaatccggtgcagatattaccctgttatatcacagtgtggataatgcaaaagaatactatctgaactgttcaacacttaatctgaacaagcagaagggtgttctttcattggaaccgaaccatggtaacgcgaaaaaccgtaatattttcatggacacttatgtaatgcgcaaagatctgtttatggaactggttaaaaagggaagaaagatttcttccatgttcacacttaatgatattgtgaatatggcatgcagtgaactggatgtacgtggagtgtcacatcgaggattctttgcatctatcacagattttacgagctactataatgcaaacttatcactgatcgatatgaagaatgcagtgactttgtttgataagaactggccgatttacacaagaacaaatgattcatgcccaacaaagtattatgaaggagcaagtgtcaagagttcagtaatttccaatggatgcctgatcgagggtactgttgagaattcggtaatcggacgtggatgcgtaattaagaaaggtgcagttgtcaaagacagtgttatccttccgggagttgtaattggagaggatgcacggattgaagcgcaggtagtggacaagagtgcaaggattgtccatgcaaaggaactgattgcagatccggaaaaaccaggatatgtaagaagaaacgatactttataatataatcaaaagaaattcaacagagagaagaatgccggcttgggcagacttctctctgttttttggtttcataaaaaagaggctcataacgaaccccttttgctgctttgtaaaattataatctattcgcgtcccatttgtaaaatcgggctgatctttttgtagatcaggaatacgatcaatgataccaggaaacctttcagcagattgaaaggtgcaacagaaagtaaaacaaaagtcagaagactgttgatatgactgttgactgcggttcccatggcaaccagtgcgtcgatcggcatatggaatgcagcagcgtatgccggaagcagaaggtatgcattgataaaacatccgacaattgtcataaaaacagttcctgttaccataccgatgatcgcacccttgcgagaatgtaacttctgataaatcagggaagctggaatacacattgcacatccgatcaggaagtttccgaggtctccaacaccagctgttgatgtacctctgatcaggaggttcaacaggattttgaccagttcgatcaaagcgccggctacaggtcccatggtaaatgctccgataaggaccggaacttcactgaaatcaattttgtaaaaggttggtgcaaatggaagtggaatatcaaataacatcagaaccatagcgattgctccgagcacaccaatctgtgcaattatctttgtgctgatacgttttttttctttcgttgttgtttttgggtttgtcattacatctgtactcattttttctctccttttctcttgacataatcagatgaattgaggaggaaaatcttcgaaagcctatgcaaaaaaatccccgacgtaatacgtcgggggattatttgcaaaatcactttttcttctctcatccagactttactgtcggttttggaattgcaccaaatcagctgtcagaaatctgacaggtcgcggactgtaaccgccggttgggaattctgcttatactatagcgataagaagtcaccctaccccgaagaatttccttgttcatttgaacacattatagcgcaggcgtatataaaatacaagtacaagttaagaaaagacagtgtttttctaaacccggagtgagcagtaacgacttgtttccaaagattcggtatgatataatcggtgtgacttaatctgatatggaggaaaatgaatgaatataaagtttgaagtaaaaatgacaaaaaaagccatgtttgattttatgctctatacttcctatacaagccttagtggaatcatcggtgtgattttcggtggtgtaacactggtgctgggaatcagacaatgtatgtttggaagctacagtacagctgcaacgttctttttgtttgccgcaatttttctgatcggaaacccacttcatttaaaagcacgtgcggcagaacaggtaatgcgctccccgatgtttcagaaaccgattagttatgaacttaacgaagaaggaatccgcatttcacaggatgaacaaagtgtgcttaatgaatggggagatttccggaaggcagtttcaaccggtcagtctgtaattatatatgtaacaaaagtaagagcactgatttttccaagagaatccctgggagaacagtatgcggcagcagtgcagatgatttctacacatatgccagccaagaaagtcaatatcagacacgtcagtgcaaattaggaggcagaccagaagatgataattgaaacaagaaatgccaaagaaacctatgatctcggtaagaagatcgggagtcatgcaaaagcaggagaagtctatacactggtaggagatctcggcgtcggaaagaccgtatttacccagggactggcaaaaggactggggattgaagaaccgatcagcagtccaacatttacaatagtccaggtatatgatgacggaagacttccgttctatcattttgatgtgtatcggattggtgacattgaagagatggacgagattggttttgaagactatgtatatggagacggtgtaagcctgatcgaatgggcgaacctgatcgatgagattcttccggcgaaccggacagagatcacgatagaaaaagatctggaacagggatttgatttccgccggattacggtagagaaaagaggagaataatatgcgcattttagcaatagacagttcgggacttgttgcaactgtcgcagtagttgaagaagaaaacgaaatttccaaaacgattgcagagtatacgatcaattataaaaagacacattcacagaccttattaccgatgttggatgaaatcgtgaagatgacggatatgaatctggatacgattgatgcgattgcggtagcaggaggaccgggatcatttaccggactcagaattggttcagcaactgcaaagggactggggctggcactgaagaagcctttgattcacattccgacagtagacggacttgcttataatctgtgttatacagacaggatcatttgtccgatcatggatgcaagaagaaatcaggtatatactggtatttatcagatggacggtgataaactgcaggttttggaagcacagatggcagtcgaaatcgatgaacttgccaaaaaactttgtacttatggaaaaccagtgatctttcttggagacggtgtaccggtgcataaagacaggttggagaaggaattgatgacggatcatgatattgcatttgcaccggcacatatgaaccagcagagagcggcagcagtcggtatgcttggaattcagtattataaagaaggaaaaacagaaaccgcaatggaacacaaaccggattatctgcgtgtatcacaggcagaacgggaaagagaagaacgtctgaaagcagaaaaaacacatgagtaatagagataacatagaaattactttgataacagaaaatgacagagaacgaatggaacaggtggcgcagatggaaacagacgtatttccggatccgtggagttatcatgaagtgagatcaactgtcagacagaagcatactttttgtgcggcagcaatggaaggggataccctgctgggatattttctgtgttattatgttctggatgaatgcgagattgcaagaattgcagttgctgaatctgaaagacgcagaggaattggacagatgctgtttggatttatggaacagatctgccatgaaaagcaactgaaaagaatgcttcttgatgtccgtaagagtaatcagacagcgattgctttttatgaaaaaaacaaatttggaatcgatggagagcgaaagttctattacggagggaaaaatccggaagatgcaatcctgatgagccgtatggtttagaaaatggaagaaatcgcaagaatatacaagacttcccactggaaggcgtcagtctgtgacgttataatgtacctgaacatagaaagagctgaaaaatgaaatggcagtcttttttgcaaagatactcaggaggaagtaagatgcgtaattataaaaaaattcagacagaaaaaaatacagtcacaaagattgtgtgcaataaatgtaaaaaagaaatcacaataaaaaatggaataccggaggaagagatgcttacagttgaaaaaagatggggatatttttcgcacaaagacggagaactccatcgatttgatatctgtgaggaatgttatgatacctggatagcatctttccagattccggtatatggagaacaggagttagaatgttagatgtatgtttgcttggaagcggtggaatgatgccgcttccttatcgatggctgaccgcacttatgacaagatataacggcagccagctgctgattgactgtggtgaaggcacacagattgcgttaaaagagaagggatggagttttaaaccgatcgatgtaatttgtttcacacattaccatggagatcatatcagcggacttccgggacttcttcttacaatgggaaatgcggacagaaaggaaccgcttactctgattggaccgaaaggtctggagagagtggtgagttctctgcgagtgatcgcgccggaactgccatttgaaatccactatagagaaattacagagccagaacagatttttgagatggatggatatcgtctgaaagcatttcgtgtaaaacataatgtgatctgttacggttatacgattgagatcgaccgtgccggcaaatttgatgtgcagagggcaacagaacagaaaattccgaaggaatactggaaacatcttcaaaaaggtgagacagtagagcttgacggaagaatactgacgccggagatggtccttggaccacctcgaagaggaattaagcttacctattgtacagatacaagaccgacggattctatccggaagaatgcaaaagggtcagacctgtttatctgcgaaggaatgtacggagaaaaagaaaaagcggcaaaagcagtagaatataagcatatgaccttttatgaggcagcaaacctggcaaaagaggcggaggtaggagaaatgtggcttacgcattacagcccgtccctgcgccatccggaagaatatatggatgaagtgcgggcaatctttccacatgcgatcgcaggaaaagaccgtatgacaacagaactggatttcccggaataagcaaagcagtagagagaaggaaaaatatggatacagagaaaaaggatatattaatactggcaattgaaagttcctgtgatgaaacggcagcagccgttgtaaagaacggacgacaggtgttgtcaaatgtgatctcatcacagatagatctacataaattatatggtggtgtggttccggaaatcgcatcgagaaagcatattgaaaagattaatcaggtaatagaagaggctctggaaaatgcagaggttacactggatgatattgatgcaatcggtgtaacttacggtccggggcttgttggtgcgcttcttgtcggtgtggcagaagcaaaagcaatcgcatatgcgaaaaagttaccacttgttggagttcatcatattgaagggcacatttctgcaaattatattgagaatctggaactggaaccaccgttcttgtgtcttgttgtgtctgggggacatacgcatctcgtatgcgtcaaggattatggaacttatgagattcttggaagaaccagagatgatgcggcaggagaggcttttgataaagtggctagagcaattggcctgggatatccgggaggaccgaagattgataagctttcaaaagagggggatccagatgcaatcccatttccacgcgcgcatatcgaagattccccatatgatttcagcttcagtggcgtgaagtcagcagttttaaactatattaacggctgcaagatgaaagggattgaatacaaccgtgctgatattgctgcatcctttcagaaagcagttactgatgtgctggtagacaatgcaatgcatgcagtaaaagaatatggacttaataagtttgcaattgcgggaggcgtggcgtcaaacagtagtcttcgtgcagcaatgaaacaggcatgtgaaaagaatgaaatagaattttactatccgtcaccgattttctgtacagataatgcagcaatgatcggtgtggcggcttattatgaatacataaatggaaccagacatggatgggatctgaatgcagtcccgaatctgaaacttggcgaaagatagagtgggcgaaccacgaaatgcaggtaaaaaggagagaataatatgaacagggaaaaatgtacagcagtagtcctggcagcaggaaaaggaagccggatgggtacaaaaatacagaagcagtatctggaaatatgtggaaagcctgtactttactattctcttgctgcatttgcagcatctccgattattgatgaaattgttcttgtgacaggagaaggtaagactgattattgccggaaaaatattatagaagcttatggaatcacaaaagttaataaaattgtggttggtggaaaagaacggtatgaatctgtatataaagcactaagagaaatagaaccggaaggttatgtctttattcatgatggagcacgtccgtttgttgatgaatcgatcatagaacgaacttaccaggcagtaaaagaataccgggcatgtgtggcaggaatgccatcgaaagatacggtaaagattgtagatgagaatgatttcgcagtaaatacaccggaacgaagatttgtgtggtgtattcagactccgcaggtatttgagactgcattgattcgtcatgcatattttaaattgatggaaaatgaagaaaatgaaacagggataacagacgatgcgatggttgtagagcgtatggaaaactgtgcagtaaagttggtagaaggttcgtatgagaatataaagattacaacgccagaagatctgatattagcagaaagtctgatcaaaaaaagaaattgaaaaaattaaaaaaaagtgttgacaataatgtatcactatgatattatctatcttgtcgctgatacacagcaacaacttaataaatgcggagaggtatcgaagtggtcataacgaggcggtcttgaaaaccgtttgtccgaaagggcgcgtgggttcgaatcccaccctctccggttgaagcagaacaatatgttctgctttttttattgttctgcttggttttttgggggagtaaaaaggtgaaatgaaaaaaggtaagagttacctttgaagttacatcattttacaagattaaattccacataagagtggaatttaatcttgtaagtgagtaatatataaaacttgaaaatagtactggacaaaaaagaaagaatcgtgtatattaaataacggacgttttggagaaatacccaagctggccgaaggggctcccctggaaagggagtaggtcgttaatagcggcgcgagggttcgaatccctctttctccgttttgttcaaagctaaaaagcagtaatcgataaaacataatattgaatgtaaaatacagatcaagaaaatgtgaaaaaagtcgaaaaaagtgcttgacattcaggaaaacggatgttattataaacaagctgatgcatgagaaatgaaagttttaaatgcagaacaaaaaataaaaaagttgttgacaaacatgaaacactttgatataatataaaagctgtcgcatgaaacggcaacaacaaaaagaacattgataactgaacaatagacaacaaaccctgaaaattctttaaagagatttttcaagaacactgaggtggctccgttagtccggacaggtggctctcgccacaccggactggcggctctgccgcaccgtaatattcagttcctggattcctcatgaattggacaaatgattatctgaatcgccggattacacagctacagtatgaaacaatccggcagcagtgggataaagcttcactggaaaagactctatcagaaattcacgaacggcaacaggacaaagaaaagcactaacagaaaattctatctttcccgtcagtgcttgttattatttatcattataatgatatctacatgataaaatataaatatttttgtcatcaattttataaatcaatcggtccttgtcgttaattctcctgctccaaaatcctgtcagatttcctgttaatggttcaggttttcctattccctcatttccatttcggtcaatatcttttataagattattgattttttttaaagtctttttatcttctgtctgccaataagtgtaatcttcccagccattatcagtaaacaccttattcatcatcaactacctcagataacgtatgagaagcaaaatttcctttttctaactgtgccttagactccattaaccagtcataattagccttatttcccataacataaacattttccatcaaattattataagcttcttctgacatcataacaacatttttattgttcttacgagtaacaatcattgtttcataatcatctgttacctgatccatatagcttttcatattatctcttaaatttgtataattaaccactaacatagatttcacctccgtacagttttctgtacttatattataacgtacaatattctgtacgtcaatatcaattataaaataggatttagtggtaacccttcatccatttataacactaccccctctttcttaacattattataaaacggtaatgttcccaaccaatattcaaattggtctttatttttcactactacgcttatatctacaccgtaatccatttgaaaatcaaaagctaaatcaaataacatcggctctgttttttcaatctcttcatctgtcagagttgtaagaatcataatatctatatccgaatgctcattataatctccacgagcatacgaaccgtataaaataactttgtctaatttctgccctaacagcttttttacttgctgtgaaaattttaatacaatatcatgtattcgattatccatatattttcactccttcctgtttgaaatgaaaacccggtttcatcgggaaatcaaggctcagaaacccttattttacgggggattttcgacctcgattttttgattttgctaaatttcgcttattcctgtcctgatataataaatttctctccattttttatatctgcattcttatctatgaaagccaattccattcctaaactattagctaactttgcaagttcatcaggagaaaatgtatttcgctgtactttattgctgaagttctgtttgcttattcccaacacctctgccatttctaattgtgtaatttttttgcttttgatatatctttaattgtctgttttaaagccaacattttgtcctcgctttctctatatctattacaagatatactgtgacaaatatagtataacacaaaagtttttcccttaaaagcaccaacaagatttctcctgccggtactttcacttctaaacctgtttttccagtcttcctatgaacagcttagataaggaactgttatttctgacgatggagatggagaacttgacacaggcggttatatcaagtatgatgctgatttgaagcaaggcgacagagtagaaacggtactggtttacaatccggcaacaaactttgatgatgatatgatgtacagagccgatactttaatcaaataaagcacaaaaaataggactgggattttctcctagtcctattttcatgtcctgataactggtctatagcaacggttaaatttaagtaccggtgctacttttaaacctgaccgatatgcctatactatttgtgtatggagatataaaatatctcaaataaacatacttctcttcaatatgcttgtgtcaaatatcttataattccatttatccctaaaactcaatcttatacacagctctctattcaattattttacaattccaattgggttaaaattgggttaaattaaaaagaaaaggagttaagcaatacgcctaactcctgtactatagccttttttaattagttttctacagtaacgatttctctcttgttgtaagatccacaagctttgcaaactctgtgtggcatcataagttctccacatttgctgcatttcaccagattcggtgcgctcattttccagtttgctcttctcttgtctcttcttgctttagaagatttattctttggacaaattgacataggttacacctccttaaaattcttgtaaagatcgcggataactgacattctagggtcaagactggtgtcttcgcagtcgcagcttccctcattcaagttctgaccacatacactgcaaatccctttacagtcttcgctacatagaactttcatcggccaccctactaaaatctcgttatagagcagctgctccacatcaagatgatatccgtcaatgtaattcgcttcatcggattcgccatcatcttctccgtctgccagagctgtattcacctgcttttcaaaggaaagcgtgaaatctgtcggtacatctgtaagacatctgtcacacggaatgattaccgtaagacttgtctcacaactgatatgaagttttttttcgccggcatactcgacatgaatatgcacaggctgtgtccggcttaccggaaatctgcttccgttcaccttcacttctttcatctcagtgccgaccacttcgtcaatggacttatgcggttcagataagacttcggacaggtcaattaacataattctttctcctgttcacacctaaactattataccatgtaaattctttttgtcaaggatgatttacagattttaaggttttttctaatttcttctgttatacaagtgcaactgtctctcttgcaattgcaagttcttcgtttgtcggaactacaagaactttcactttggaatctggtgtagagattacgatctcttctccacgttttccatttgcttcttcatcgattgtaattccaagatatccaagatagctgcagacttttgttctcacaagtgcacagttctcaccgatacctgctgtaaatacgatattatcaacaccgttcattgctgctgtgtaagcaccaacatattttgctactctgtatgcaaatacgtcgattgcaagttctgcacgcttgttgcctgcttttgctgctgcctcaagatcacggaagtcgctagatacaccggatacaccttccacacctgatttcttgttcaggacattcataattcctgcaatgtcaaggttttctttcttagcaatgaattccatgatcgccggatcaatatctccggaacgtgttcccattacaagaccttccaacggagtaagtcccatagaggtatctactgattctccgttaagcactgctgaaacagatgctccattaccaagatggcatacgatcgtctttgttgcgttgtatggttttccaacaatctcagctactctcttagatacgaagctgtggcttgttccgtggaatccgtaacgtcttactttgtatttttcataatattcatatggaagtccatacatataagctttctcaggcattgtctgatgaaaagcagtatcaaatacaacaacctgtggtgtgcccggcatcagactttcacaagcttcgattccgattaagtttgccgggttgtgaagtggtgcaaggtcattgcactctgcgatcgcagcttttacttccggtgttacaactacagattttgcaaacttttctccgccgtgaacaacacgatgtccgactgctccgatttcgtcaaggctcttaacaacacctgtatctgcatctgtcagcgcgtcgattacgaactggattgcttctgtatgtgtaggcatagccttttcagatacattcttctctccacctgccggctgataggtaagtcttccgtcaataccgattctttcgcaaagaccttttgcgagaaccgcctccgattctgagttgatgagctggaacttcagtgatgaacttccgcagttgattactaatacattcattgatgtttctcccttctggtactagaattttctttattagaactcacactctattcttaattatactccttgcacacattgtatacaagtaatgttatttttttcacgtaatattttccagtacaatgttttttgcacaaaaactctttttatagtataatcttttcacaaacaacacaaaggagattttagttaaaagtatgaaaatcgtcggtatcatcgcagaatataatccgttccacaacggacatcagtatcatatagaccaggcacttcaaaaaacgggggcagatgcggcaattgtccttatgagtggtgacttcgtccagcgtggcgcccctgctatcgcgccaaagcatttgcgggcaaaagctgcccttcttggcggtgcatcactcattctggaactcccggtccttttttcctgtggcagtgcagagttgtttgcaagaggtgccgtttctatttttaacagtcttggctgtatttcctatctctgctttggcagtgagtgtggcgatatcaaaaaactcaatcggcttgcccggattctttccgaagagccagaagtctaccggcagctcctgcaggatgagctgcgaaaaggccgaccgtttccgcaggcacgccagactgctctaagtgtctatacaaaggatccgtcccttgccgaaatcctgtcctcaccaaacaatacccttgggattgaatacttaaaagcgctccggtatttcaaaagtccgatccagcctttcgcaattccccgcgagggatccggctaccacgatactgacctctgcgaaaccttcagttccgcaactgcgatccgcaaccgaattctgaatccatctttaccagaaggtgctttttcatccgttgcaggacaacttccgcccgcttcttcagatctgctgcgaaagaattaccagtcctcacttccagttacccaggatgatttttcgctcctgctaaagtatcgactgctctgtgagagtgcttcctctctgaccgattaccttgatgtcagcaaagacctcgccaaccggatcatcaatcagagaaatgattttgctacctggagttccttctgcgatcttctgaaaaccagagagcttacctacacccggatcagccgcgccctgctgcacatcctgctcggcataaaaaaggacaccttccgacatgagcctcctttctgttttgcagaagattccggcaacatttccggcaaaacaaaaaaagagcggtcatccacatccgccctttatgcccgcgtactcggttttcaaaaaaaagatactcaaatccttaaagagatcaaagagtatgccaccatccctctgatcacaaagctcgcagatgccagaaatctcacctccgccacccaggtcctcctgaacctggacattttcgcatcagacctgtatgaatccataattaccgaaaaatttggcacaccttttacaaatgaataccagaagcagttgcaaattatttaacccttcccctttgtcaaaaaagagactttttgcacaccgctactacgcatgtttgtgcaaaaagtctctttctcatttagttcacatgaagaattttggtaagagtcaccgccctggctccaggtccgatatggcatgccacactcaacgacagtggatccatccgtatttcaaactccggaaatgcttcatgaagctcatccagccattcctgtgcctccttgcgatctcctgtgtaagctgcatccagatacagatctttttttccatcacaatctccgaattctgaagtacgaatctcattaattgtcttgatcatcgtcttctttgcactcttccatcctcttgacttcgcaaacgcatccagcttttctcctttaagacggagaactggcttcaggttcagaaccgttccaatcgctgcagctgccggtgtaagtctgccgcctttcttcaggtattttaaagtatctactgtaatatagatatcactgtcccactggatcgcttctaacagttctttaatttctgccgcgctctttccagcatctgcaagctttttcgcctcttccaccgatcttcgctgcgtaacagaaatccggtgattatttacgacctgtacttttccatcatagtcctgggaaagcatgattgcagtctcacatgaactgctaagaccggctgacatcggaatatgtacaacctcatcatattcctccagcgccttgtcccacatatccattacatctccgggagccggttgggaagtcttaatatctgcatctcctgccagtttttcataaaactcctcctgcgtgagtgtgatatcctcgtaaaacaactcctcattgatatagaatggcatcggaagtacgtaaattcccatcttctttccttctgcctgtgtaattccactgttactatctgttacaatcgcaactttccccatgctctctttacctctttctaatttttaaaactatgtatcggtgcaggaattcttccctttcgattcacaaatgcactgcagtcaaattcattgaccggcatgatcggcgcatatcccaaaagaccaccaaactctgccatatctccaacatcctttccaactacaggtatcacacgaaccgccgttgtcttctgattgaccattccgatcgccatctcatccgcaatgatcccggaaatcgtagtagctttcgtcttacccggaatagcgatcatatcaagtcctaccgagcagacacaagtcatcgcctccagcttttctatacaaagagatccggcattgactgcatcgatcattcctttatcctcactgaccggaataaaagctccgcttaaacctcctacataggaagacgccataacgccaccttttttcacctgatcgttcagcatagcaagtgctgctgttgttcctggtgcgccaactctctcaagtccgatttcttccagaatctccgctactgaatcgccaacagccggtgtcggtgcaagtgacaggtcaatgattccgaacggaataccaagccttttggaagcttctccggctacaagctgaccaacccttgtcaccttaaatgcggtcttcttgatcgtatcacaaagttcctgaaagccctcaccacgacatttttcaatcgctctttttacaacaccaggtccgctgacaccgacattgatcacggcatctccttcggtaacacctaaaaaggcccctgccataaacgggttatcatccggtgcattacataaaactacaaattttgcacagccaatcgaatccttgtcctttgtcgcctctgctgtctcttttacaatctcgccgcaaagacggactgcatccatatcaataccagtctttgtcgaacctacattgaccgaactgcacacacgctctgtctttgccattgccatcggaatggaacggatcaggagttcatcgctctttgtcattcccttggatacgattgcagagtatcctccgataaagtttacaccgacttcctttgctgctttatccattgtctctgcgatcgtcacaaaatcctctggttgtttgcaggctgaaccgccaacaagtgcaaccggtgtaatggaaatccgcttattaacgatcggaattccaaattcactttcgatcttctctcctgtcgatacaagatcctttgcaagtgttgtgatttttttatatatcttttcattcagtctgtccagatctgagtcaatacagtccatcagactgatacccaatgtgattgttcttacatccagattttcttcttcgatcatctggtttgtttctactacttcgtaaaaattaatcatagcggttctccttacactctgtgcattttttcaaaaatctcttctctctgacaatgaatattgacaccgatctgtaagccgatatcacgaagttctaccgctacgatatccagttctttttttgaattttccacatctgcaaccgccatcatattaaaatacccatccacgatcgtctgggaaatatttaaaatattgatattggtctctgccaggtatgtacatactttcgcaataattccgaccgaatctttaccgactactgtaataatgcatttcttcattctgcctgtcctcctgaatccaattctgcatactttctttttctaaacctcgatcactgcagacacctgatccctttttgcaactgcgatcggtatatcctcccccttatacgggttctgccccaaagtgacctccagcttgacagtctcatatgcaagttcttcgtaattattctccttgctcaaatgccccagcaatacactccgcaagttattgtgtagtatatcacaaagaagccgtcctgacaattcatttgataaatgtcctctgtccccaagaactctctgcttcaggtaatacggataaggaccgacttccagcatatgtatatcatggttagattccagaaggaccgcatttaaatccttcaggttctctaccgtatattcatcgtattttccaagatccgttgctaccgcgatcttctttccatcctgctcaaagcggtagccgctcggttcatttgcatcatgggaaatagcaaatggatgcacgtcaatatcacccagcttaaattctttgtctacctggatttcatggtaaagtccttccggcatttccccgagatttttataatcacggattccccgaatcgttcccggtgttccatagatcgggatctcatattttctgctgaatacaccaagtccctgaatatgatctgcatgttcatgggtaatcaggattccatccagctctttcccttttatttcaagttcctttaagccttcctcaattcgttttttgctgattcctgtatctacaagcagatgcgttcgatcgctccccacataaatacagtttccgctgctgccactggcaatactgcataatctcatcttgtttcttctccctgttcttagcctcttcccagtgccaagtctatctgtttttccgtttcttcaaaggttccgccgttttcgatcacaagatccgaaaccgctgtaaatgtctcttccgacggctgatttgcaaacaccgcatacattttttcatctgaatatccgcgtgaacttctcagtctctccatccggatctcctgtggcacatgaatataccagatctcatccaacatctcacgatataccggttccgtaaggagtgcagcttccagaataaaaagctcttttccctcttcctgcgccttctgcatttcctcccggatcttttcattgaccgccggatgcacgattgcattaagcttttgcagtttctctggctgatcaaacacaattctgccaagaattttccgatcaatcgttccgtcaggatttaaaatttctttcccaaacgtctccacgatcttctgataacatttttctcccggaagctgtacctgatgtgcaaccagatctgactggcagatcaccgcaccgcgcactacacttaaaaagtcgagtactttgctcttcccggaaccaatgcctcctgttattcctatttttctcatatctgtttccttctattttgcctcataccagttttttccactatgcatgtcaatttcaagcggaacggaaagatctgccgcatgcatcatgccttctttcaggatctcccgcacttcctcttcctcttccttccatgtctcgatcagaagttcgtcgtgtacctgcagaaccagcctggatttcatgtttctcatgcgaagctctttgtccacagcgatcattgcgattttcatgatatctgcagccgttccctggatcggagaattcattgccacacgttccccgaattgtctctgcataaaattgctggaagacagctccggaaccggtcttcttctgccaaataaggtcacaacatatccctgttcttttgcatgagcaactgcatcatccagaaatttcttgatgcccggataggtttcaaaataacggtcaatatattcggccgcttcttttctcgtaatacttaaatcctggctcagtccaaaagaactgatcccatagacaataccaaagttgactgcttttgcatttcgcctctgcagatcggtcacttcatcaaacggagtatgaaacacctgagaagctgtgatccggtgaatgtcctttgcctcccggtatgcttcgatcagtgctgcatctccggagcaatgtgccagcacacgcagttctatctgcgaataatccgcatctacaaacacatatccctcttccggcacaaatactttacggatcagccgtccaagttctaccctcgccgggatattctgcaggtttggctctgtactgctgatacgtccggtcgctgtaactgtctggttgaattttccatggatccggtgatcatcttcatgaataaacacggcaagcccatctgcataagtcgatttcagcttggcaagctgacgatattccaggatttttgccacgatcggataatccggtgccagcttatccagtacgtctgctgccgtcgaatatcctgttttcgtcttctttccatttgggagggacagatgttcaaaaaggaccacgcccagctgctttggtgaattgatattaaattcttccccggcaagctcataaatttccttttccagctgtacgatttttccgccaagttgttctccatagcttttcagttcttctgcttctacacgcaccccattttgctccatgtggaacagagtaaatacaagcggcatctctatttctgtaaaaagcttccacattttctcttttttcagcttttcttccaaaactgccgatgacgcaaatgcagcataggcttcataacagaccattttttccagttctgtcttcggatcgatcatcaatccaagatgctcctgtgccacatcttcaaatccataatcatttttcaacggattcaggaggtaagctgccacaatactgtcaaagcacttctcctctgctgctccttctaatcctttcagataaggcagggatgacttcagatcaaacaccacaaaccgtccggcatgctttgccacatgtacaagtgcctccagaagttcctccatgctgtatccatttcctgccggaatacagtagatcttctcttttccaaacgaaattccaattccacctatctcagcatttcctgcaaagagcggaagtacatttctggtatctttgtaaagaacggctcccaccgtctgcgctttttctgcctccgcaaagattttctgaatttcttcttttcccacagcgatcacaaatgcatcttcaatcgaattctcactctgcacatcaaaacgattcagcagattcttgaactgcagtctctggaaatagacataagcttcctctgtataaagatttccaagcttcgcctcttccagttcataagcaaaatccgcgtctacatcgattgtcgccagcaccttactcatttgtgcctgatcccagtattccaccagatttttcgatgctctcggcggcttcagttcggatgcatgcttgtaggcattttcaatagatccgtattctacaataatcttggtcgccgtcttttctccgactcccggcacccctgggatattatctgaagtatctcccatcaatgcttttacatcgataaattctgtcggtgtcacctggtatttttcttttacgtccactgcataataattttcgatctcagttccggtccgttttgtcttcggaattcggatctcaacatggtctgtagcaagctggagaagatctctgtctccggaaataatgaccacttccatcccaattcgctcgcatcttttggacagcgttccaagaaggtcatctgcctccagcccttcctgctcgatcgtccggattcccatagcatgcagaacttccttcatcaacggtacctgctgtctgagttcttctgccatcggctttctcgtccccttatacgcctcaaacatcttatggcggaaagtcggcgcatgcacatcaaatgcaacggtcagatactccggcttttcctcctccaggatcttgaacataatatttaagaatccatatattgcattcgtatggagtccttccgcatttgtcagatccggaagtccgaaaaacgccctgttcagaatactgtgtccgtctatcaatacgattttgctcataatcaactgcctctctgtaagtctcatcacttacttctatcttttctatctattcgttcaaatatacaacatctcattatgacatttttttttgatattttcaatacatgaaggggtaaaaaagatcctcatcaaaattacagatacacgaaatgtgccacaataattgtgtatatacgaaaaaatacatcacgaatcatcgcaatgtacttctcatatcttttattcaattccagttaattatcaactgccggcagcgggacttgaacccacgaaagggtccgcaaacccttataaatcaagggtttgcggcatcgggtaatcaaaaggtaatcaaaaaggtaatcaaggaaaaagagaaggagagttatcgcatctacttgagaattaccattcttaaaacccgatgtcattacaaaaaagttcgtatggtactataaaaaacgaaaggggccttgcggcccctggcagattgaaaaagcccaaagttttggcgaacggacaggctctttcggaaagcgagcttctttgaaaactcaatgaggctcaaaggtggctcttgttgcttcgagtataccacactcggtaagacaagcctccttttccgaaagttccaatgacctaagaggaggttctacatatgccacacaaaatgatgaattcgcagatagcagacgtgcttcacgacaacaggttgtcaatcgaggcacgtatgctatatgcatacctctgctcattcgatgatggcgctccgccctcgacctgtcagattatcaggcagctcggtatcggcaagacgcgattctatcgatatcgaaacgagctcgaagcgtttggtctcatcgaggtcgagaatacgatcacgtccggcggcggggtcgcaaagtactcttttcccgacgagcccgtaccgaccgcagaagccgaggagattttgatcacccgcctgatcaacaataacaacaaagcgatgaattttaaaaaggaaaggaatgatggaaatgcagggaaacgcaactgaaatcgatgagcgcaaccttttgcagctcgatgcgctgctctcccacggatatggactctcgccgcagctcgtgatgagatcaaagggcctatccatcgaggcgaaggcactctacggatggaaagcacctggttatccagttgcttcttagtcggtgcgtatgtatagaaaagccctgtgaaaacataaagacgttgatttttgttctgaagattatcgatgacgtcttcggtctcctctttagagtacttgagctcctgcggaaggattgaaaagtcatagcctttctgaactgccgaacgctgctcctcgatgatctccttatcgatccaggccaaacgctgtcgcgtgaaagcgacggcagccgctttatccataggctgtgcgaaccaagtgacgttaagcggaatcgggagctcggtgatatcggaaagcgcctgatcggttagttccgaaccaagcttcttgataacaagaacctgaccccacatatcacccgtcttgaagcagtcggcaagtccctccggcttgaaatcgagtgtcgtcggtgcgatacagtcctttgtcgtctgcaccattctggcggagatatcccgtcgataatcgaaattaaacggtttgagcgggttgagctggctattcagaagtgccagtcgttccgcaccgtcgagtacacggctctttgaaccgatggatgtgagaatctgcgagatctgattttcgatacgggtaagtttcggaacggcatcgtccaccgtggcggcagaaactgaaaaggtgatatacatcttacgccggatgtttgaaacaccctgacgcatcttctcgttcaagatctcattgaagacggcggcgtcgtttgcagcgtttacattcagctggctgctcggattgaagaacttgcgataatcaacaggagtttgttccggttccgtctcaggtacagcatatgcagtctgaggattggcttgataggtatttgcaggttgttgaggttgcacggcctgttgggcagatgcgctcaccggaacgttgctttcataatccttgcgggcggcggcaatcagttcggttgccgtggcggcgtcgatttcgccagcggcaaccttagccatgataaaattgattgtatcgttaatagatgactcgacctgcccttgggctgtaggcttcgagcccgtttgtcccatcaaggaactttctggttgatttgtcataaagctttcctttcctgctttgcgtgatctcatccggcgttttcacgaacccgctcttaaacattgacggtttgtaaaaaagtcgattatcagagagctggtgctgtagccaaagaagggcaaattgctcgaatggcagcccgtgaggcttccaaaagccacagcaccaacagggcagtgaaaccgcatagatgaactccaggtgatcggtcgggtcgatcttcaaaacgagattcatatagacggcgacagagatggaaagccctaatgcgacagtgattgaaataagggtacggccggtaagcttaccgatgactttcggttgatattcggcgatatccttatgaattgcaacgctaagcatcgggcatttcctcctttagccggcgaaactggtgtccaggctgccgaggaaaacggaggctgcgatgacgatacctccgccgacgatcatggcgatggcgccggcgagctggccgccaccgccttgcataccgtctttaattgtcataccgagattgacaagaccgaaaacgatgaggacgccgccgagaaaggtgacacctccggagattttggtcatgatttgagagagcatacgctaaattcctttctttaaatattcttagatttcatgagcttaatgcccggtgtagccatagagcgccattgctgccgcgactgtaaaaccagctgcgatcattgcaatggctttaacgatttcaggctggcgccttccaccgcttgccaacgagatgccgagatagattaggccggcaatgccaaaagcagtaccggcgaaacctatcggctgggcaaaaatccttataagtttatccacccattcaattcctttcctttttcccgtgtcggttgcactggttcagtgtataccaaacgcgtgagttatgacgcgtaggtagcgtcttttgtcctaatttcgtccatgtattccaggatatcgaacggctcatcatacagacagcggtttttgacctgacccggcttgtttcgaccggggtcgagatagatgtagttagggtgttgctcgaccgggtatttcagatctttaagcggatttgtgccggcgatgagcaggattgcctcgcggcgattcatcttgccgatctcagcggcgtcgatcaagtcgcgaccttggatctgaatgtttttcgagctggaaccggactgtccgcgcgtctcgccgaaggttttctgattgatcgtctgcttgccgatcatctcggagatttccttgttggtggaattcgacttgccgccaaggaagagagtggtatcgcaacaatcgataatcgtttttgcctttttatcgtagcggctttctagctgtgcgacagactggagaatgatcgagataccgatgtttcgggaacgggtgacggcgatggtctgttcgatatcgggaatcgtgccgatatttgcaaactcgtcgaagatgaaattgaccatggtcggcaacttgccgttgtatttctcgagacatctggtttttaataacagaccataagggaatcgtgaaagttgtggtacttttaattgccattttctgcgctatctcgattggaatcggtgtatatacaacctctgttcaaacccaagaacaacaaaaacaagagcaaaaggcaaagaaaaaggagcgcgagaagcagattaaaaaaagttctgtcacgttgacaaaagcacagcagaagattgtcgataaatatgaccagtcaactgcacagttctccgcccttctctcttccaatatctgggcaacctacagtggcaccggacgtacgctttattttaccgaatcatccataatcatcgccgacccggaagccaatccgaacaaggttgaaaagccttttatcatcaagggtctatcgactgaaaaagtcgatgtcggcgagatggtgaaccttactcgctataactgtgcctatgaatcagacgatgacaaaacgcatgtcctgaccgtcgacaaaaacgatgacggcacgtatttcaagatgtctatcgacgtggaaaacaatggaaccaatgaggaatatacgcgaacacaagcagcgggttcctttgatatcgacggtatcgatgatggtttgagtgaaatcctaggaaatgcgaaggataccattgaagattatgtgcgtgagcagtgtgcgctcttctacccgacggctgtaaaagcgagctgcaacgggatcctgactgcagatttcaatgctaacgagtatggactcacgctatatgagcggacacacagtcgataccggtcatgcttttatcgtttccccgggaacatacgaaccgtatatcggtatccacgatcctgtctacggcgcgggttatatgatggtcgacctcgataaaccattcgaagtcccgatgaaccgtatctggatcgccatggatgactacagtggccctgagaccaaggagggtctgcgtggaatgtaccacagcccccaagatgtcagtgccttcagcgaccctttctgcggttccgtcagcgtcacgccgactcgcgatgagaaagacacgctgcgtgtccagcacgcccggtgtatacgctaccgcgggcgccagcggatccccgatcctttcagcgaccatcaagggcaacacgacggtttacgtcgattggccttggagcggctacgacggcgtcatgagcgcacggtcgtagcggatatcaactgaaggaactgaaagaggggcagatggagtttcatctgcccctcttttttactataagccgttttcaaacgtgaatattaagacaaagaaaaagggcgagacctagagcgtttggccgggatccagttccccgaatactactctaagctcgcctctaatactattatacaaaaccatctttgtatttgcaaccgcggaaacaagcaggtcttctctgccactaatccataggttgaacaaagaaaagaatacatgcgctctattcaagaaatgaaaaagcctcatctttcatcgcaaatgaaagatgaatccacccgttaaaattcgcaagcgcttgcgaataaaaaagaagaaggctgcggagagagaccgcaatcttcttcttttcctgtataaaaataggctgatgccggtagataggaataccggccaacaaggtgattcccgaaggaatcttcgaaaacaatactactatagcatagtatagacagtttgtctacttcctctgtcgcgccggcaagacatcgtcgggatcgatctcatagagcccgaatgccgccgcgatcttcatcatgtcacgcataccggcaagataggccgtatcgacctggtcgcaggcatggacgcggacagcgcggataaagcgatccgtcacatcccgaagctcctgcggaatctcatgagagatcttgagccaatcctgctccgcaagatgctcttccatctcactttgtcggaagccggggtcacgctcgctcaactcgaccatcgacccgtccttcagctcagacagggccgagcgcaaagcggcctgaaagctattttcctccatacgtatcctccttccgttaatgcaatatgctagtattatagcactatagcatccgaaaggcaaccgtatgttcgagcgtccaaggtatatcgcgcctttcaaaaccgatgcagactatagcccgatttatccggcacgagcccgtaaatgcttttcggaaaatactcttcaactgggactgattcccttgccgcatcgaagaggccggatttcaaggcatgaattatccgctcttccgcaactaccgccatgagctcgcagttactcaatgcgaagaatatgatcttctccgtgccgaataatttggcggcactctcccataccgatgacaagagcagcgccgaggcgcctcccactcccccgctcagcctaccgatctccaacatagcgagctgccccgttgtgccggtgaagccgatccgtatatccgatttgaggttgcgggatgcatattcgaacagcttccctctcggcaagccgaatgaatcgagattgtcatacgtcacgattgcggccgcgtagccgtccgtttcggattcaccctcgacgacgtaggtgacaagcagatcgagatagcgatcgtagatgatccccagctcgtcatagccgtcagccttccaggccggcgacagcaccggatagatcctgtacggtatgacttctttagcagggaccttatataccccgtattccatatcaaggtcgcatatcggctgccccacatcgaacgcatcaaccatttcatttcccatccgatctcctatcggatggaagcggcgatacccaccgcgccacatccttcccatatcaattcctcctgtaatgctttgtgtaatagtactatagcattatgaggatacaattgatatacggacatcgatgtacgaagcatttcgatgtttttcgatacgaaaagaagcatggcatgaaaagagggaagccgatcggtggcttccctctgctgaaactagcgcgtttcttccgttatgctaatgtcgtcttgctgcttcggaagctgcaagattctatcccgtttttgttcaaggttgacgcttcgtgaggctgaaacatcgtgcacatgtcccggagcctgaagctcggcaagtccacgatggacaacggcttcggcatgttccgcgcccttctcggctacaagctcgaagaccggggcaagcgtctcgtcaccgtcggtcggctgttcccgtcgagccagctctgtcatgagtgcggctaccgcttctcgggaaccaaggacctgtcggttagggagtggacgtgccccttgtgcggtcgcacccatgaccgcgacgttaacgctgctcggaacatcagggacgaaggtatgaggctcgcgctttcggcctagaggaagcgaaaccgtggggcacacggggatagctcgtcgatactggcgacatcggttgccttgagcgagaagcccccacctctagcagcgaagttgcaaggtggatgggagcatgtcacattggacatctggaaaattgtctggtaaaggcatagtcccaatccggatcgatcacacctggcgcccctgcactaaagcgagcgttttccctccaattttctagggtccaagaactcagatcttcggataggttcatgcagccatagaacatcctgttcaaatctactgcccgcgaaatattccatgtttcggcaccgatttttcttagcctttcacatccgaaaaacatctcatgcaagtcaacagcactgtagaggttgtagccgtccatgccgagccgttttagcgatttgcaaccatagaacattcgattcgtatcagcaaccaacggcattccgaagcgcggcatcctgacctgctcaaggttaccgcagctttcgaaaagaccctgagctgcagtcgtgtatgtcgtatccagtttctccagatcggctgcacggagattttcaaaccggttgaaccaatggcagagttttctcggttttatcccgccatctgcaacggaaacactggtaacgcgattagctatagcgtcagttgtccaacaatgatcgttaaaattttcgaagaccttcgttacatgctttccagcaaattctgttcccaccacaggaatgtgcccatagcggtaaaaggcaagcgaatcatcctctgcggagtatatggcaaattgcctgtcagccatctcgattcctttctctcggcctgcggcaatatgattgcctaacaaacgagaaggtcttaaaaccgtggaatctatggtcgaaattgtttcagatgaacgatatggacaagccataccactgttttaaatctatccttagtatgctaagtgatcgctcaatcgaaaacgccttgtaatactagagaaaaaattacccaaatttttcgatgatactaaagtcgaatcgtgttatagtcttattgtcgcttaacgaggaggcaccacctgattcctttccaggtggtgcctccgcctttttatagccagataatcaaatatgtcttccgaaggctttgcgctttacatagagcgttcgtcatcgttgtgggcggaaaacatcatgtccttttccgccatccagccgatgcggactgcacctctcttgccgtctcgacagatcgaaaggaggtgaaatctatgggtaacagcgacaaggacttcgagaagtcaaaccaatgtgcgtttgacgcctactgcaaagtaatcctcagaaatgaggcaagggacgcatacgaccagcgtaaacgcaaactgaaacgcgaacagctcttcggagagatgtcgcctgaagagctaaacaagctcatcacgacagaccggtatttccaattcgaacgggatatcgtggaagacggtttgcatttcattgtgtgcgaccagggcgtatacgaagcgctcatgacccttcccggggcaaaaagaaagatcgtccttctatcctacttcggagagatgaacgaccgcgaaatcggcgacgcgctcggcaccggacgcgccaatgtccaataccatcgctcacgtgcgctcgcaatgatgcgaaagacgctcgaacaggaaagtgaggaatactgatgagcaagcgaaaaaacaaactagttccattcgaaaccatcgtcctcgcaacgcagggcgacccacgggcattggaacaggttatacggcattacagaccgtacatactctcactctgccgccgggaatacattgcggaaaacggcaacgtctccatcgtatgcgacaacgaactgaaactgcgactggaagcgaagctgatggcaaaaatcctgctgttcgatatcagagagaggacatacaaaacgtaacacgtaaatcaaaattgaaacacgactcttaaaacctaaagatagcaggggagaccgcgaaccggtctccccttggttacgttgtacaacctgatcccgctgtggtataatactaccatacaataatacagtcacggaggcaatccaatggagaaaaataccaaaacgcttgctttaggagacgatcctaaaatttctgaaatgccaaaaagcgaggatgagcaacgtaggcaaaatgaagactatgccagaaatctcggacttgatgtgatcgacccgataggggactgaatcgcggaacagccgactggacatggtaagggctggtagcgtataaccgctaccagccctttcgtctacctatcttgcctggaggcgggcaatcaacgcttcctgcaagactttggaaaaattgattccgcgttcctcgcatgatgcattcagccacccaggaatcgtcaatgtcttctttaccgacttctccccgtatttcctctcgaacgccttgagatcgatgtcgaccatattgacaatcgctccatcctcctccgcaatgacatcctcgatggaggaagccaccggaagaacattgccttccttcaattcattgaagagatactgcccacatgcctcctgggccatcgcaaatgcatccgcaaaatcatttccgtaggtcgccaaatcattcagatctggaaaaataaccgaatagcgaccgtccgcttctttatagaacaccgccggatagatatagcacataccgtttcctccttaatcaaaaactacttcagccccgcctgcctcagcacggaaatcgcgaccctcaacggaatgtcgccgccatgcctcggtatcgtgaccttccctttcttcaacggatgccggtactggtaatgcgatcctcttacatcacaccgaatccagccatccgcgacaatcagcctttcaagctcccgaaacctcatcttccgtttaccctttctctaattatagcacgtgtaatacgtggtgtaaataccatactactacggtacgaaactactaccgataacaccgatcttttgcaaggcaggacgctttttgcgcgtcctgcctgctggtttgtgatatatcattttctgtgcattccgactacgggttactggtatctcggtagcatagtaccgtaatgctattcagatttaagagtcttcacgaacttcgccacaatactctggctggattccgccatgtcatcgaggagttttgacgcctccaccttgtcgagcttgccgacctcgatcaccgtgtcggccgccctagaatatgcgtcgagcgcggattcgattgcgaacttggctctcgcaatagctccggtcagctccctgttctcgattgcctcagtcacttggcgtttggcggcatcgatctgtttccgtgcgacgtctgcaacggctttcgccgccctctccttttcctcaagttcggcacgttcctttgcaaacttagcgttcatctcctcttcggcttttcgtcgggcctcggcaacctgtcgatctctctgtccattcagttcgtcgatctgtttaagcagttccgactgcttttcggcagcggcatcgagtttcttccgctcctcttcaagggcaataccgattgcctctttctgccgcttctggttggatttctcggcctctgccgcccgtttctccaatacctcgatctgagcagcaaccttggctttctcggcagtcaatttcgccatttgagtatccttttgtttcagctcgtcagcgaacttggcttccgcctcggctgcgttcctgtttgcaagctctttaacggctgtgaccttttccttctcctgtctcacctcctcctggagcttacgaagcgccatctctccagctttacgttcctctgcaaatctcgcgcgctcgtcttccggaaggtcaatcaaagccaaagcctgcgtgtagctcaaattcgcaagcgcttgcgatttctctgccaacccgttctgaccgtactcctgatagatcttcatgaagttgttcgccgtcctctggctgtaatcgaccctttccttaagccacgttccccacgtgccgcgcttcaccatagctttcgcctcggtcagacgccggccgatctcgattgagttgaacaggacgacctgtttcgtctgttccgtaatcatccggatctctgaaaccagcctatcctcccttgcagcatcctcgtcggagacatactggactgtctcctcactctccgtttcagtcatcatcggaacgacatttccccttgcgatcacttgagcctcgacctctacgtttttcttcgctcttcccatcttgttttcctcctatttttaaatgatttaggctgaacagcttgtctgttctgctgtgcctataccgggcatgaatgcaacgtagtggagcgagggcgcgaatcaagggcgaagtctttctgccagtttttacggagcatgcggaggaaaaagttgcagaaagatgcgtaggcacccttgatggtcaagcgcaggagcggcatagaatgccaatgcctcggataggcccagttcccgatcccagagggaactttcctttttccaaaaaggccggcgccgattgagcccggcataatttaggcaatactagcgtactgtggtatcaaaatgaggacttgcattttcttcaagtgacacgtaaatgtctgcgaaaagaaaattgcaaaggggaaatataactatgaacgacgtcaatggatatgatagtactatcaaatatgctattatgaatatcgtaggtgcgatcaacaaaatagaatcaatgaaacaagatagatacttaacgatgcatccatattccatcacgcatagcgcagatggctattaccgaacatatcttcctgccgacgatggcaaacgtaaacaaattaaaaagaaatcgaaaagcgatctcgaaaaggttgtcatcgattattggatgaagcgctcgcctacatcttttaaggagagatatgccgtatgggtagaccgtcaaaagctaaaaggcgtttctgataacacgatatacaaatatcagaccgactacgcacgtttctttaaaggtaaaaaaatcgaaaagagagatgtccgaacgatcgatgaagaatatttagaactattttttgacgaactgctttcagaaaaggaagtgccctatcgggcattgaaagcactgttcggttatcttaagggggtattcgataagtcgattagggatggattgattgaaagcaatccgtgcctaaaaattgatttgccgctttacaaaaggagatgcaagcaagcgattgttaagacgccggaagaacggacattttcacaaagcgaaaaaaatagactagtaaattctcttaacgaaaaacgaaaagagcgtcctgatgatgttcttccatatgccgttgagcttgccctttataccggaatgcgtgtaggtgaactttcaggattgatgtggaacgacatcgacgaagtcaacaagcgcatccttatccggcacagtgaaaaattaaatcgactgacaaacactttttacatctcgacgcctaaaaacggaaagacgcggatcttcccattgacgatcgaaatcgccgagctgcttaaaaagattaaaaatgtcgagaaaaaatacggctatttgactgagttcgttttctctaatgcggatggacgtattcatgcaagagtcatctcgggatatatgaaacggcggacatctaatgaggggttcactaatccaaaaagcatacataccgcaagaaggactttgaattcagagctgcttgcttccggcgcaccaagaaccatgtgctgcgcaatgataggtaatacggagcgggtaaatgaggaatactatacgtacgatgtttcctccacgagcgaaaagatggaaatagtcacaaagataaacagccgggttacttcaaatgttaacggtaactgcaatgatgatagtctttaagctatcgagtaatcaaaaaggtaatcaaaggtaatcaaacattctgaatgtaaaaatccctgaaacccttggcttaacagtgataaggaactaattcacttatcaactgttagctgacggatttcgggtgcatacagaactcccggaacatctttacggcagggacggtatcgcttatgaagattatgagtaccagctaccaaagaaaaaattgaacaaagagacgctgataaaatactacgaccttatccgtccgacaaggtgtgtgattgaggaaagccagcggtatttacgattggaacatgaggacaaggaaagctatgtgtcctattttaccgtcaatgcgattgtaggagagcttgattttccgtcgtctgaaatcttctatttccagcaacagcaattcacattccccgttgatacgagcatgaatgtagaaatcgtggaaaatcggaaagcattaacgaccgtccgcaacaagaaaaaggaactgaaagaccttgataatcacgcctatcaagcaggaagtgaaaccagctcaaatgtggtggacgctttagacagcgtggacgagctggaaactgatttagaccagacaaaagaaagtatgtataagttaagctacgtcatacgggtgtctgcacccgatcttgacgagctgaaacgccgttgtgatgaagtcaaggacttttacgacgacctcaatgtaaagctggtgcgtcctgctggggatatgctggggcttcattctgaatttttaccagccagcaagcgatatatcaatgactatgtgcagtatgtaaaatcagattttttagctgggcttggctttggtgcgacacagcagttaggagaaactacgggtatctatatgggctattctgttgatacgggaagaaatgtgtacctgcaaccgtcccttgccagtcaaggtgtaaaaggtacagttaccaacgctttagcgtctgcttttgtcggttcgcttggcggtgggaaatcgttctgtaacaatcttctggtatattatgcggtgctgtttggcggtcaagcacttctgttagaccctaaaagtgagcgtggtaactggaaagaaacgctcccagagattgcacatgaaatcaatatcgtaaatcttaccagcgataaggacaatgcagggcttcttgacccgtttgtgattatgaagaatgtaaaagacgctgaaagtctggcaatcgacatcttaacattccttacgggtatttcttcaagggacggcgaaaaattccccgtacttcgtaaggcagtacgctccgttacccagagcgacagtcggggcttgctccatgtgatagacgagctacgccgtgaagatacgcccatatcaagaaatatcgcagaccatattccgcaaaggaaaaggcaaagtccagcgtgtccgacttcaagcgtggcatggtgcaggaacagcagtccagacagacgggacgcttggaaaagcaggaacagcgtaagaaaaatatcgctgacaaacgtatggagcttcaaaaggcacaagaagcaaggcaggtacagcgaaaggctgacggatcagcgacaacgggagctacccgtccccatgagcgaccagtcacagcttcaaccattccaaagccgagtgttgaaaaaatgcaggaagtcaaacgcccagccacagctccaactccgaaagcaagtgagccagtcaagacaaatgttatcaaagagcgtccgttatcttctggtgcttctgataagaaagcaccccagcctacacagacagtacataggcagaatgtagaaaaagtggtatcgcaggaaacacgccagaatgacaccaaagaccgcaggataaaggttcagcagacccagagcgtccagaagaaccagcagaccatagagaaaacccgtaaccttgtaacgaagaaaggacagaagaaaaaatgaaactgaaacatatcgctatcattggcagtctgtttcctatcctcttttctctggtgcttttctttggggtgctgattagtgcggacagcgacgatgagaacagcaacttttcttctggcattactggtatgaacttatccgcagaagtcttgaaacatcagcctatggtggaaaagtacgccagagaaaacggtatctccgagtatgtcaatgtgctacttgctatcattcaagtagaaagtggcggtacggcagaagatgttatgcagagttcggaaagtctgggtttaccgcccaactctttagatacggaaaactcaatcaagcaggggtgtaagtattttgcgtccctgctttcttcctgcaaaaatcaaggtatcgacgacttgaatgtagcaatacagtcttataactatggcggtggctatgtgggatatgtggcaggaaaaggaaaaaaacacacttttaatcttgcagagagcttcgcccgtgagaaatcgggtggaaagaaagtaacctacaccaacccgatagccgttgctaagaatgggggctggcggtatggctatggaaatatgttctatgtggaagtagtcaatcagtatttagcagttccgcaggtatcgggagaactggcacaaaaggtaatgaatgaagcgttgaaatatcaaggctggaagtatgtgtatggtggcagtaacccgaatacttcctttgattgttcgggattgacgcaatggtgctatggaaaagctggtatctccttaccgagaacagcacaagcacagtatgacgcaacccaacatctgccactctcgcaggcaaaagcaggcgatttggtgtttttccattccacctataacgctggttcgtatgtaacacacgtcggtattcttgtttcgccgacacagatgtaccacgcaggcgacccgataggatatgtagacctaagtagtagttactggcaacagcacttaatcggtgcaggacgagtaaaacaatagaaaggacttgaaaaatatgtttaagaagaataagaaacagacagaaactatcaaagaaccaaaagaaaaaaaggtgcgtactgtcaaggtaggcacacataagaaaaccgtgattgcgttgtgggtggtgcttgtcgcaagcgtgagctttggggtgtataagaattttacggctatcgaccagcacaccacccatgaaaaagaaatcattgaacttcgcttgcaggacaccaacgggatagaaaatttcgtgaaaaactttgcgaagtcctattacacatgggataacagcaaagaagctatcgaagcaaggacgcaggcaatcagcggttatctgacaaaggaattgcaggacttaaatgtagacaccattagaaccgatataccgaccagctccacggttacagatgtgattgtatggcatatcgagcaatcgggagcggacactttttctgctacctacgaagtagatcagcagataaaagagggagaacagacaagcaatgtgaaagcaacctatactgtaaaagtctatgtggacgcagacggggatatggtaatcgttcaaaaccctacccttgcaccagcagttgaaaaatcagactatgagcctaagacaccagaagcagacgcaagcgtggacgctgatacggtaaatgacgctaccgcttttctggaaacattctttaagctgtacccaacagcgacggaaaaagagcttgcttactatgtattgggaaatgtgattgaacctatcggcagggactacctttattctgaactggtaaaccctatctttataaaggacggcgacaatgtgaaagtcaaggttgcggtaaaattcattgataatcagacaaaagcgacgcaggtatcgcagtatgagcttgtgctacataaggatagtaactggaagattgtaggataaatgatatagcgtgcatttcctatcagatttgcacgcttttacaaaacgacaagaaaactgtgcaaaaatattgacttgtaatgaccgaatgctataatataaataacaagtgtacttggtattatttgaaaggagcgttatataatggataaagaaaaaatactatcacaaaacaaaaaagagaatctatatcttgatgaatacgaaaaacatattaaacttcaagggaaatcttttggcttaatgtttgttttatttatctgcattttaattcttttcattaaagcagtttgtaaagaaccttactatgacataatgacaattattgggtctgtggcatttggctctatgggttatgaagcacatatttcaaaaaataaatccaaatttgttattgctttattctttcttctatttatggggtattacttttataaatttttaatggtaggtttatagaatggacgaacatttaattttgagaaacagattaaaaactgtacgaaaagaaaaaaaattatcacaaacagaattagctgaactagtcggggtttctcggaatacaattagttctattgaaactggacaatttaatccaacagcaaaattggcattagtgctttgtatagctttagataaaaaatttgaagaattattttattttgattaaaggagagaacgattatggaattagaggaattgattgttgaaatagttataggattgtttttactttttacatcttatcaaataggtataaaagagaatattactttattacatggttatcattatacacaacttgaccctaaagataaaaaggtgtttacaaaaaaaataggaataggcactttactggttagtattggtattcttgttatgcctattatcaatttaatctctcattctgaattaggctattacataggtcttattttgatttttgcaggagtgttttatatcatattcatcattgtaaaatacaatggaaaacttattagctttaaaaagtagaattgaggtatgaatatgataggactgaacaaaagagatataaaaaaggcattgaaagctggtgcaaaagctggcggtgtattattggctgatgttcgggcggatattgaagctacgattgatgaagctatgaatagcaccgacccagaggtgcaggcaaatttcaaaaagtattttgggaataaacgtcctacaccagaagaatatatttatatcattacgaaaaagacaaaggcaaaattataataaaagggtcgtggaaatgcttcacagaattgtgatctgcattatcacggctcttttactctctgtttactttcaaaaacattgaaatttttggaaaaaaaataagtgacttaaccaaggaagataaagaaagtattgcagttgtatatgatacaaatagtttaccggaacatctaactgcgaagaaaataaataacattttcaaaagaatatataagaattggtgtagtgataaattttatcatatgattgaacggttgcagataccatctgacacatcaataaaaaatatgtcaaaagggaataaaatgaaaattaacttagtggttgctttggcacataatcctaggctattaatattggatgagataacgggggtattggatcccataatgcgtaatgatattatgcaattattccttgaatttgtgcaagatgaacatagaagcattttattctcaactcatatcaccacagatttagaaaaaatagcagattatattacttttattaatagggggcgtgttgtcttttcaaaagacaaagatgaattgatttgtaattataaactgatacattgtcgtgcgtctaaatttgatgaaattaataagactggaataattgcatataaagaagaaaaaaacagggttgattttatatacgattgctctgtatgtaaaaattttcaatattcaaatgatgttgttatagaagatactagtatagaagatattatgctgattcttacgaggggacatatattatgaagggattaattattaaagatttttatagtattaaaaaagttatgagcatgtacgttattttaacagttcttttgatggtatattgcattgtaagaaatcgatatgaattcattccggcaataccgattttgatatttagtacgacgattacttccacattttctatggatgctgcagtagaatggaatagattggcggttacaatggtagaaaagcgaaaagatattgttaagtgtaaatatattttgtttctattaatcatattatttggggggttatgcagtgctgttttaattacaccaagtataattattcgggaaattaatgtcagagctacaattgagattgtactgttgatattaagtatagcattttgctcgggaagtatatctcttggaattttgcatttttcaaccacaacaatagaaaaaatagaattacttacattattttcttatatgacatctgcggtagttgttttacttgttggaaagatattaggaagcatattagaagtagataaaattattatttcggttataaatttattggctatgtttgtactatattatgtttctttctgcatttcagtgaaaatatttaacaagagggatatttgaatattcttgtggctcgaaatcacggattcgtaaattgtcttttggtacttgattacgtgtccatttctatggggatatttgtcaaggtcttgtcgcatctgcggtgcgtagtagcctttactactaatattttcatagaaattatgatttggtatgcacaaacttaaatataaaaagtgattttcatatcaatggacagctgatggaaactcacccggaatattcaatattacctgaggtgagtttcagcgcctatagggggtggtaggatggtagaaacgagagaaataaaaaataatatcttgttttcggaattttttaattcatatgtaacatgtgcgaaaaacaatcttattatgcggttagaagtaaaagataaaaatatatcagcaataaaaataaattcatgtgtattattatttaatgatattttaaaaaaattgtttaaattagggataagagcattaataagtgagttacataattataaaaaacaaggtaagctgagtggaaatagcacatatgaacgctataattatttcgaaaaacttacggctcaatcagagtttaaggattatttttttaagaagtatccagttcttgatatgatgatgaaaagttatcttgatgaaacagtaaattatattgtagaaattgtagaaaattttattaaagaccaatcgttattagaaacaaaatttcatgtaaaacttgattgcataactgatatttcaataggtttgggagatacacataatagtggaaaaacagtagcaattgtttattttgaaacttttcgattggtttataaaccgcattcacttacaggcgattatatatttgagcaaatattacaatggatcaattgtaatgcaaacatacgactcgatttgaaaaatgtaaaagcattatcattgaatacaaggggatgggaagaatatattgagcaacgttcttgcaatagtatagaagatattagaaggtattattatcgtatgggatgttatttagctgttttttactcattaggtacaaccgatctacattttgagaatgtaattgcatcaaaggattatccgatgttcattgatctggaaacattatttggtaacagcaaaatagacaaattttcaaccgttcttgatacaggtcttctgcctcaaataagaacagattctttaattgatgttgatacaagcggaatatgtgggaaaagtaacaaatctaattctatgaaatctttgacgattatttatcctaaaactgatgaaatggcggtggaggaagtcccggctatcgtaacaaatagaaaaaatgtagtgatctttaaaaataaaattgttgaaatcgaagactttgtagacgatttgattaacggatatgatatgacaataaattttcttataaataataaagaaaattttatcaatacgattctttttgatatgcaagaaaacagtaagtttcgaattgtattaagacatactcaagtatattcaaaatacttatctgcggctcttcatccggactatttgtcagatgttgagaaaagaaaagaattgtttcaacgtttacaaattaactgtaaagaggagtttgaaaataaaagagttcttgaagaagtgcatgaactattatatggaagtgttccgtattttatgtttgatttttataccagaaatttatattcttatagtggggtggtaaaacaagactattttcaatacagtggttatgattttttgctgaaaagaataaatagtttagataagtataaaacagcgaacagagagctgattaaaaaatctttgcaaacatcttatttacgaaaagataatcaagcaggtagaaaattcagcaatccaaatgtcactcaagtaaaattactgtttctaaaatatataaattatattattgatggtatctttgatgctaatgatgggtcagctatgtatttttttaatcgtttagcagataatgctatttcattagaaattatcaatgtggatttatacgaaggtggcggaatcattttgtgccttgctcttgctgggagagtttataaaaatgatgactatttcaaatatgccaaaaaactgttaaaaacggcaacagaaattctaaaatataagcatagaatgaaaaatacggttgcattaagtgccttttctggctatggttcactactatatttatgttatctattacataatataacgggggatgattattataaaaaagaggctgaaattacaacggattttatcctgcataacgattatttaaacgaacagtctatatgtacatacgactatttagatggattagctggagttattgtttttacttcaaacttgctaataaccaaaaaaaatgtaaatgtaaaaattagaaaattgtttgataaaaccgtcgatttgcttaataactttatcaaaaataacaatatatgcaatgtaggcttggctcacggattatcaggatatgcatatgcttatataatggtatacaaagttacacataaggataaatatctacttaaagcaaaggaattacttctttttgaagatcaactctataagtcaaataagacacaaaaggcttcttggtgtaaaggggaaacgggactgtgtatttctaggataaaataccttgaactttcaccgaatataaaaataagagatagttttgagcattattataaaatcctatgcacaaaaggtataaatgatgtggaaaacatgtgtttatgtcatggattgtatggaaacatagaaataattcgtgaaataaataaaattttaaaaaatcaaaatataataaatgaacaattaatacttcccaaacttccagtattaaaaaaaattgaagatatctatttgggatataataaaaagttttatacagatacatttatgacgggactaagtggaatactctattcattactgcgggaggaaatagatttaccatctatattattactaggagtctgatacgaccgtaaatgtgaagggggatatgtatgaaaataaaacccattttacaacttacaaaaacagaatgcggaatatgttgtttatctatgttggcgagatattatggctatagcatgccaataaaatattatagagaaaaggttgatataggaagagacggcgtatctgttgattctattgcattcattttaagggagataaattttgatgtaaactattctcgcttaaatgattttgggtataatgaaaaaaataattttccggtaatagttcataccaaaagtaatcattatattatttgggaaagctataataaacaaacaaataatgtcattatagtggatccggctatcgggagagtcaaattttcgatcacagaattaataaatttgtcaagtggtttaattatatgtgcatatcctaatgagaattttgaaaaaaggaaagaaaaagaatctgtatggaagccattactgtttttagcaaaatctgtcaactccaaatttatagttgcgttattgctaagtatattgacttattttttttcattaaccattccgctgctgattcaaatgttcatagatcgcttgaatatgaatgttgtaatattcaaagattctgacctacttttggcaatatgttctttagtattatttttattcttaagttattgccgaaataaggtgatagtcagtatggaattagtgatagacaaaaatttactaatggaattgatggaacacattttaaggttgccgtataaatattttgaaacaaggtcaacaggtgaaattatcttcagaattaatttgttgaatagcataaggcttttgatatccgagggattgattcgaggaattattgatgctggcagtgttctgtttatattagcatatatgttttgcttatcacacaatatggttattgtcgtcattctcattttagtaggaattttcttgcttgcaaggtaagcgcttaattttttggtatgataaaaaaatccccgactacttttcagtagccggagcaccttgacaattcacatatgattgatttgattcgtttgcacgacgttcgatttcagctttgacggtttcgttccatggcgccagaagttctaattcatcatcactcatcctgtcatcaggcagtttttccagcagataggtaagatagtgatagacgtttactccattggcttttgccatttctaccattgtgtacacgatagcgctggcctgggctccgtttggtgtatcacagaacagccagtttttacgacctactgtaaatgggcgaatcgcattttcactgagattattagaaaaactgcagcggccgtcttccagataggtggacagataggagcggcgattctgaatgtaggtgacagctttgtccattctgcttccacggatagggttctgctgatcaagccacgacaaaaagccttctactaccggcttttctttttcaaggcgagcctttttaatagcatcgaaggaagaatactttgatctgatcacatcttccagatggaagagctggttaatgtacagcattccctgtacggatggctgggtataatccagcgcctttcccttagggatggcatctgtcagatatcttctgatgtgtgcccagcaggctgtgcgtttggcatccggtactttattgtatccgctatagccatcacacatcagataacccttgaagccgtgaagaaaatctacggcattgtccccggcccgggtctccgagtatttatagaggataataggcggtcctccgtcttcgccgctgcggaacagccacatatatgacttggtctgtgcacggcgttctggttcatgcagaacctgaagaggcgtttcatctgccatcacgaatccacgtttcagaagtttcctgtggaagtattcgtacataggaagaaaaaacgcttcggaattccggagcacccagtttgccatagtagctctggtgatctccactccatactgtttccagtccttttcctgacggtagtatgggagaccattacaaaacttctggtacattacccaggcaaccgttccggcagaagccattccataaagcatatgggctctgccatcttttccttttttgatgaccggaatatcctgaagcctgcactgcgggcactcatagctcttactgtagtattcatataccttcagttttgccggtacaaagaccagttcccggcggacaaactcttccccgatttctttcagcgggataccacagacagggcagagtttctcttcctcagaaagttccagatactttttttcaacaggaactcccttaaaacgctccgcatctgtagctcttgcttttcgcttttttgctgttttttccggaagaattgcttcaagatcctctgcttctgcagctttcggatcctgttccagttccgcctcattgaaaaagtttaactggcctggaatatcaagggtccttttttcgctggaggtgccaaacagttttttgcggagaaggtctatctcttctttcagattatcccgctcctgggtgagagcttcttcccgtttattggcagcatcgacagttgcctgaagtgtttttatcatctttttgagatcgtttatcatgtccttcagctcacggagctggatatctttggaactgtctgccactgctttttcctcctgtttctgatgtttccattataccagaaaacagtggcttttcccagcaaaacagcgaatttaccagaccttgaaagtgccgaaaatacagcaaaaagcaagagttttatgtgcatcttttttatgttgccttgatcgctttgggctgctcaatatcaatgccagacatcagccagtcgaactcccgccatgtaagattccggacctcagatttattcctgggccaccggtaagatccctgggaggtcagtcttttgtagatcataacgatcccgtcaggttcttttaaaatagccttgatacggtcgcatttacgaccgcagaaaagaaaaagtgcatggtcgatctccatcgaaaactgttcctggatgatcgcacataatccatcaatggacttgcgcatatctgttctgccacagacgatatagattgcatcaacacttgagatgtccgctaacataacgactccttaagcgtatccataagcatcttcagaagtaacggtttaatctcattactcattcgtataagcaatccgtctgcttcgatttcaatcgtatgtgaattgtcaaggtgcataggtctgtttccattatctgggatcagtcctgccggagaagactccggttctatagcaatctggactacatcctgtttatgggatgtaaggtcaagagtgctggcttttccaactggatccggtatctgacagacttttttgcggagacgggtaactgcattgtaaaaacagctgggagatatcccatgctcattacaccatgcagcatctgtcaggccactttgtctgcattcggttaccagatccatccattcgtccagggaacgccctggagcacgtttcttactcataatgaaacctccaaatgtagtaaatttctatctcctatcaagcggagtgtagtaaaaatctatttactatcattatgagttcaaaaacgtagacagtaaagctacccaagatttaagcgcttaccttgcaagtgctattagcaatcgagttgtggtgcttaataaatcggaattagctgaattggcacaaataagtaatcttgaaacagaaacagttgaaatgatttttgatataaagtgcttaggggttgaaacattatttttgaatcggctaaaagaacaatatcagcaatttcaaaataaatttaaaatcagagaattattatcaagatgtaatgtttcactattgcaattttttcaacttttcataccatttttacttttattggtaaatttgtattatataaatgaaactcagttatctattggtatggtagttgcgttttatacattaagcaatatggttatcacaaattgcatagcattagtgcaagaggttacaaattttagacttatgaaaaactatattttgcgtataaacgatattttatgtgaagatgttgaaactaataatcattataaaatcaatgagtttaaaaatctttccataaaaaatatatcgttcaaatattcagaaaattcaccgatattattaaatggaatcaatattcacatagctaaaggacaaaaaattgctattgtaggagaatcaggaagtggcaaaagtactattgtaaagttacttttaggtttatacgaacctatgatgggaaacgtacaatttaatggcatcaatatggaagatttggataaaaatcaattaaaaaaaataataggagttatgccacaagatgcaaagctttttaatggaagtataaaatataatattatggttgtgtatatgatctttatcaacatgggtactgatcacgtattcatattttccttttaacacttcatccgcaaattgctgtccgagacgatgtgcagtttcagcgtcaacttccccaggcttaaacgactgaatcagatgaaaagccagattatcacctttatccattccgtttttctttgcagtttctctggtgagagcaaattccagatcggctgtttcaggcgaacaaccaaagctggaaaccagtagtttttcatctgtcttatccggattggtgatatagtccagagctttcttgtcagttactttaatggggaagatcttaatatatgccatagttcttttaccatctctttcagttctttcatttcttccggatacagatctccggtggtattcactttctttgcaatctgattgatattcacaccaatcttgtgcatttcttcatattgtttcttcaggggagtggtgtcggtgttgacaatatagccgtcgattgccattttacgaagatacgctcccatgttttttgtctttgactgaatcatcttcatacggatcagctttcgttcttcctctgtgacataaaaatgaatttctttgtttctttttctttcagccattagcagtttctccttcctgaaagggggtattattgttgctttcagctttttcaatttagggcagggtaccctgaattgggattttccggaagtgtatcctcacttcctgtccttgctgttttacccctctattagttaaagtcaggaaaaagagagaattgcaaaagaatttgggcagtagtaggaaagttggaaatgtgatatgattgggaacaggatataagaagaaacaggagttgaacagtgtgtgagtaaagaagaaatctttgaatatgtgcaaaagcaatatggaacgcttccagaatatctgtggaggaaatcgccggatagtgcggttcttcggcataaaaatgggaaatggtatgcagtaatcatgagtgtagaaaaatctaaactcggtttagatggagacgacatagttgacattttagacgtaaagtgtgatccggaaatgacgggcatgatcattcagacctatggatttttgccggggtatcacatgaataagaatcactggatcactattctgctggatggaagtgtgagtgaagcaaagacgttagattttctggatatgagttatgacctgattgataatgtcgggataaagtagaaaaatcttggatgatatgttgaatgaatatagaaagcgtgagggacgaaatcatggaattgttgcagacagtcagaggagatatcacaaaaatcacagatgttcaagcaatcgtaaatgctgcgaataattcacttcttggaggaggtggcgttgatggagcaattcatagagcagccggtccagaacttttgaaagagtgcagaaaattacatgggtgtgagactggtgaagcaaaaattacaaaagcatacaagctcccttgtgagtatgtcatccataccgtaggaccggtatggcatggcgggagtgaaaatgagaaagaattgcttgcaaaatgttatgcctcatccatgcaactggcaatggattatggaatcagaacaatagcttttccatcaatttctacaggggtttattctttcccagttggattggctgcgaaaatagcagtgaaaacagttggtgaatttttgagagaacatccggatgcttttgatttggtggaatgggttttgtttgatgagcagacagaactggtttatgcgatagaagtaaatgcttacaataaagagagacgggaataaaacaaatgagaatattgatgttagggaatagttttacatctacaaatcacatgccggatatattggcaaagttgacaggtgcagaggttgttcaacatactcgtggaggtgccagattagcggagcagttaaatccgaaaacgaaaatgggaaaacgtacacaggaggctttgcagagccagaaatgggattttgttattttacaggaaatgagcaacggtccgatcagttcaaaaaagagttttctggaaaatgcaggaaaactctgtgagcagatccgggagaatggagctaaaccggttttttatgcgacttgggcatatcagcgtgaaggcaagaaattggaaacttttgggatggattatgatgaaatgtatcagcaaatgtatgaagcttatcatcaggcagcagaggggaatcatgcgttgattgcagatgttggaaaaaagttttatgaactttcggataaagaagatctttatgcggatgatggatgtcatccaaatgaaaaaggatcttacatagcagcagaagtgatagcggaagttgtattaaattgaatgatatggaaaaaagcagtttgacaggtgggtgagtatccacgaatcaaactgctttttttagctgttatccttgcaaccggaagtgatatcatcatcaagttgaaaaatatcctccacatttacatttagataatgtgccagccggatagccatttcaagagagggatttctttctccacgttcgatgcgtccgattgtacgactgcatgaaccggttgcttctgccagatcttcctggatgagattccgttccagccgtatatccttgagggtgttgttgattgccattcgatcacttctttctgtgtatagtttttcagcaaaccagtggtcggctgttgagatttaatgaaaaccaggaatttcagcacctttgcacttcccgataacttttccaaaaatcttgaaagaatcagattctaatacctgaataggttggtacttttcatttaaggaaaccaggaatacaccgtctggttcatcgtgcagctctttgatataagtattgccattgagataaaagattccgatttcaccattggcgatagaatcttttttctgaatccaagcaacgtcaccagtgtggtaaagaggttccatactgtcaccggagattcgtacaccgaagtcggtctgatccggagcgagatgtcccacatcgtaagtttcttttacagaatcttccagatagtttccagtaccagcggaaaccggctcccaggagatttctacaaaatgcctgaacggaaggatttttgctggggcaggagagaacattttggaagctctcaaaatatctgcaaattcaatgagtttttttttcccttcttcattcagaccgctcatgatgttatatggattttctccaaagaaggcttcgtaaatatcttcaatatcaagtaactggcataatgtcaggaaaatgtgcaaagatggttctcgtgaattcgtctcccatttggagacagcctttgtagtgacctgaataccttcacgagagagtaattccacaagatctgactgggaatatcctttcttttttctattttctgctaatatttccccgaaagcacgcatatgttcgcctcgtttctatttgaattttctgtatgtattatactccatgtacaaaagaaaatcaacaaaaatctccataacggagaaaaacaaccaaaatgtcagttgactatctccaaaacggaggtatatactaagcgtacagaagttgataagacagaaagccttaaataatgattggaggtggaaattttgagtgagcgtgtaatcctgcatagtgatatgaattgtttttatgcaagtgtggaaatgctgcatcatccggaatttgcaggacaacctttggcggtcggaggtgatccagaagcaagacatgggattgtattgactgccaattatatcgcaaagcgaaaaggggtgaaaactggaatggcgttgtggcaggcaaagcaggtttgcccggaaattatttttgtgccacctcgaatggacctttatctgcgcttttccaaaatggcgagagagatttattctgaatacacagataagattgagccgtatggaatagatgaagcctggctggatgtaacagacagtaagaatctaaaaggaagtggaatgacgatagccagagaaatcagtcacaggataaaatatgagcttggtgttacagtgagtattggcgtttcctggaataagatttatgcgaaacttggttcggattacaaaaagccggatgccattacggagttcaatagaagcaattacaaagatagaatctggagacttccggtttcggatctgctttatgtaggcagacagacaaataagaaattgaaaaaattaggaatccagacaatcggagatcttgcagaaacagatgaaaacttgctggacagttatttcggaaagatgggaatcgtactctgggcttttgcaaatggatgggacgaagatccagtttgcaaagaaggatatgaagctcctgtaaaatctattggaaacagtaccacaacacctagagatttggaaacagatctggatgtatggattattcagatggctctggcggaaagtgttgcagccaggttgcgaaaacatggattcaaatgcaaaaccgttgagattacggttcgtgataatggcttgtccagtttcacaaggcaaaggcatttgcggcatccaacgaatattacagatgagattgtaacagaagcatttcagctgtttaaggattcttacaaatgggaacatccgatcagaagtcttggaatcagggcggcagaccttgtgctggatgatattccggtacaattagatttatttggaaatcaggagaaacaggaaaaattagaaaagctggatcgcactgtagatgagatcagacgacggtttggatatttcagcatacagagggcagcaatgtatcaggacaaagtcttatcccacttagacgctggtacgcatacggtccatccacacagttattttcatggataatgggagggatagatttgaaacagacattaaccagaaaacaagaagaaagctatcagtgtattttacagtatacgacagaacatggatatcctccaacagtgcgtgaatttggcaaattgattggagtgaaatcaacatcatctgcattttccagaattaagcagctggaggaatgtggatatatcagaagagttccagcatctccgagagcaatagaaattctgtaacgaggtgattggaatgaataaagtgtatgtagatgtagtggcagaatttcgtaaagatggatgcctggttccgttattttttgtttgggaggatggcagaaaatatagcattgataagattttgaaaattgaacgatgtgccagcagaaaggcaggcggtgtcggaatgatgtacacctgtatgatacaggggcaggagagccacttgttttatgaagtggacaaatggttcatggagagaaaaacagcataaggagaaacaattatcaaacagattattttgattattaaccggcagaggtagtcactttccctttatatccctgcaggttttacataaggagatggattccgatcagcagaggtgaaacccacagcacctttttggaaattccctcctgcaatcgcagcgagttagtattgcttcccatcaaaatcatggggaaagcggactggtaggcaagatcaccagttggtgtgatgatgataaggagattaagaaactgatgacagacagagattatgcaatcaaatcaatgaaagaaattacattccagatggcaagccatgcacaggattatctggaagtaacgattgagagacactatactgatattaaagaactgatgactaattatcagaaactgattctggagaaccagatggtactggaagagctggaaatggagtgccaggagaagatcaatgaagatatggcgtatgcgttaagctatctttcgatttttaatcatcagctcgatgtggcaaaaatgcaccgggagatgaataatctgatgattatctatggattgtctgatatgatttacagaggtatgactttggtaaaattctatgctccgaatggagtggtcctgagcgagattcttcattcctgcttttgcagtcactataataagacggatgtggaagtgcagcaggaacttggaattgggagaacttctttttacaagatgaagaaacaggcacttggatatctgggattttatttttatgaaattgtggtgccacaggcaaaagataaaagattcaagccgtctttgggcgttgaggaagagtaggtgagaaagatgagatacgaagattcaatgaaagcggtagcagatcagattatgcgagatcagaaacgggcgaagaagattgagagtaatccagaagagtttcgctggtatgatgaatatgcaacattaaatttcttcaaatacatttgtcttaatattggaaatctgagcaatggcgaaattgagaaaatggtaaccagattgaaaaaactggataagaaagcagttgaagaacataaaaaaggagcagtctgggtgtttgattatgataagatgtttcttgtgctacaggaaaatgaaatttgcagaaaagtctgcgaaaagaataaatacagaaattggatgcaactgattgggaattactgcctgccggtagtatgatataaaataaaaaatcctgtcttgtagaaaatggattttgatgataagatgaaattgggataggatatatttttgatctgtcctgacattgaccgagaatggaggcgaagaggagcgtggcgaaggaagaaaccgtaaaaacagaagaattggaagcacgttacgaaagatacaaaggtatcttgaaagaccttaccatcatgagcgatgtgttcatgcgaaatgtatttaaaaagcgggagtgtacagaatatgttttgcaggtgattatgggaaaaaaggatctgagaattattgatcaggttcttcagaaagattataagaatttacagggacgttccgcagtgctggattgtgtggcaagagattctgacggaaagcagatggatgtagaaatccagcaggataatgaaggagcatcgcccaaacgggcaagatatcacagtggactgatggatatgaatacattaaatccaggacaagattttgatgaacttccggaaagttatgtgatttttatcaccagggacgatgtactgggatttggacttccaatttatcatgtaaacaggaaaatcgaagaggtcagtgagaatttcagggatgaagctcatatcatctatgtaaattctaagaaacaggaggatacggaacttgggcgcctgatgcatgatctgcattgcaagaatgcaggagatatgcacagcaagattctggctgatcgagtacacgagttaaaggaaacacagaaaggggttgaattcatgtgccgtgaaatggaacagatttatagtgaaggtattgaaagcggtgaaatgcaaaaagcaaaagaaacaacgattgcccttgcagagatgggtttacctgctgataagattgctaaagcagttaaaattggtgttgatatcgtgcagaagtggattgatgaaagcatgagtgttgcccattaaaagatgaaaaaggttaataacagctgtggaaatttctgcagctgtttctttttttataagaaaatcgttctatagaactactacttgatttgcggcttctgtatctttcaattatccatcggtatactaattttagaccgaattatcgttctgaaggaggtgttacgatggatttgaaagcggttggtcagcgaatcaaggctgcaagagaagcaaggaatcttacacaggaagaactggcagcgctggtgaatttaagtaccacacatgtcagtgtgatagaaagagggttgaaggtaacaaaattggacacttttgtagcgattgccaatgcactcgatgtttcggcagattcacttttgattgacgttgtgacacattctgtcacaggtgttaccaatgagttatcgaaaaagatagagaaattaccgaaggctgaacagataaggatcttaaatgcggtcagagctttggtagactaataatgagcaatgaaaattgaagggcatgaagctcttctttttttgtttatttttatggaagtggttgtgaaagtaccttttatcaatgtagaaaacatgatatagtagttctgaagaactataaataattctttttgcgggagggtggatgaatgagagaaaaaactatttatgagaaaattgctgagaaatacaatacaacaccagaagaagtgtatgaagaaatgcaaaaggcaatcaatgctggatttgatgatcctgatccggcagttcaggcagaatggaagaatgtaacactcaagggagacagaccaacaccggaagaagttattgattatgcggtgaagaaattaaaaggaaattagaatttatgaaaaagaaaattattgtaattatttcagttgcagctattttaatggtagccgcaggaagtatttatggaaagacatcatcagacagaaagcaaggtgatccagatgtagtggggagctttgcaatgaaccgagatgagaatcttacggttgttgctaaccgagatgagattactgatagagaagcttttgcaaaacagcttttgcagatgtgcagggataatagtttttattcgataaagttctcaacagatcagggatatgccaccagcttagatatgaatgtttattcctggaaagaggatattgaaaatggcgaaccggttatgcgagtagaatacaaaccgattgaatatggcgaagaatatgatattgtcaataatccggataaatttcagctttatgtagatggaaaagagataacagaatagctggtgaacttttatgccagaaatgtgtacgattgacagaatcgtgtgaacttatagggggtgattacggatacattgtgaacttaagcctgttacaatgattatgctgacgaaagaaggcatagataattgaataattgataagagacggaagcctcagtagttaagaaaaaactactggggctttttttcgtgcctgaaattcgtagccaataactgcgggtgcgtcccggcagctcaaaggcggaacaggcatgaagcataacaagagtccgcctcctggatttgaaacgagcaatgagatttcaaattcaggaggaacggatatgtatattgaacatccatatttttatgatggaaagtattacgcaaatgtcgatggacagatgattgagattacgaaagaagtagcgtatgcaatgaataatttttacaggagcagcaaagcgaaaaaggtcgagatcaaaaatgaacttggcgaagtggtggataaaatgcttcgggaagtgccttatagtggtcagtcggtagacggagaaggacttatgatcgaggatttcccggatatgaattgcgacatagaaaacagcgtaattaccaaaatggagcagcaggatattcataaggtaattaaccagctgaattcagaagagcggatgatcgtgtatggcatctattttgaaaataaaacacagttacagatggcggcaattatgggtgtttccaggcaggtattggcttataaactgaaaacaatcctgaataaaatgcgaaaaatatatctgaataaaactttttaaaaatttttcaaaatttttttgcattccctgttttcatttgactttagtaattagaggaacattaaaggactcctcgaaatgtaccatgataactgaatattcaataataactgacgtaacattttatgcaaagagcacgaggaagatgccgccataggatcagagataaggataatatttgtcgatgatgctgcgaaaaagcactgaccgaagccagctggcaggctggtgatgcgaagagtggtataagatgcgatacacttgcaggtcctgagaagcctgtaactggtaaacctatgaactgctggagcctgggaatgagagtttccgggttgtggtctggagaatgtatccggacaggttgttattcccttcctgcattgtcaggagtaacgattcgggggatcgaggataaatagaatcgagcgagcactgtttaataatcaaattggctatagaggttatgcggcagaactttcttattatgaaagtattctgccgtattcctgtggagccaatatagcgctatgaatgctttgcaaataggacaagagattggagaggtgaaaatgacaatacgaagaggtgatatcctgtgggcagatctcggtatgtttccgacatcatctgttcagggaggcgtaagaccagtgatagtgataagcaacaataaagccaatacatacagttcagtgataacggtggttcctttgacttcgagaatttataagaaacgatatttgccgacacatgtgtttattagcaaatacgatatgacaggaatccataaaggaagtctggcactggctgaacaggttatgagtatttctacaaaatgtattattgaaaaatgcggaagagtaaataaatggagtctggatcgggtgatgaaagctgtccggattcagatgggaatggaaggagaaggatatgacagtaaaagaatatagatattatctggaacaggattttagtgatgtagatatcaatgaaatgactgatttaaagacgatgaaagtagacagaaataagagtattaaggatcggagagaagcatttctgaacaaggtaggaaatccgtatcttgttcggatcggaaacatgaaagtaaaagtcagatttgccaataatgggacatctatggagcaggcatttgaaaatatgcttctgagtgtctgaaaaagtagtggaaagttaaagggagctgtgctaaaatgtctgcaaggacaaatttatgcagcccccttttattacataggttttctgacgtaataaaaggaggtaagatatgtatcagaatatcaataaaatctatcgtgccgccatctatgtcagattatcgaaagaagatggcgatgtttccagttcagcgaaactggaaagtaacagcatttctaaccagaaggctttgattctggatttcctaaaagacaaaaaagatatagaagttgtttccgtccgagtggatgatggctactcaggctctaattttgagcgtccggcattccaggcaatgttggaagatatccggcatggaatgtgcgcccgtaaaggcatcataataaatatacctttggcaaggtattaggatagtatcttacagtcctatcatcaaccggaatccggtccccgctctgcagtacgatttcattcagataagtgtcaatcctccggatacatccggactttttctggtaggagccaccttcctttttctgatccggtacaaaatattcaaaatccacttcccgtggttcctgactctggcatacttcccgtaaatacagatccaatatctgtctgcaatcctcactgagtctgcgtttccgctcggtcagtctttcggtctccctgattgcatctttatgtccggtcagcgctgcaaacggggcaaactgcgccgctctgtcctcccttgacatctgcggatgtctgaccgatacatgatgcggtaaatgaatgatatcctcgtatcctgtcatgccttatgccctccgatctgctcattccgctctttggtagtggctccttcctgaaaattaagtcccttcaaaattgcattcttcccatacttcttcttaatcgaaagtactgcctcctgcatcttcttctcccgttcaaccttctcatcctgctgcttcttttcattgtctccggtaaaatcagtaaacagatccagttgccggaattttgtcttatctgccgctttcttttcatccaatacgtgattcgctgtcatcgaaatccgccgcaccatcaaatgcggattcacaatccggtcatacagttccatcaccgcatcggttatcattctcgtagaagctgtatactctcgtagattcgctgttccatgtgcatgctttggaatctttcttccataccggtccactgtcacctcccctgtataaccttttccacttgtcagattctcgatatcatatccgacagtcagcacgatctgatccgtaaccagatgcttttctacaagatcaagcgtcaaaagatccaacatctctttaaccacaattttcgccttttgggcatcatacgggcaatgtagtacctggcctgcaccaacactgttatgctccggctgatacgcttttacatctgcaatcgtacacggttcccaaccccaggcatgatcgatcaaaagttctgcattcacaccgaacattttatacaaaagctcttcattataaaattcattctcttttccaaccgagcatctggcaatatctcccatggtatacagtccacattgttccagctttttcgcatagcctcttcccacacgccaaaaatccgtaagcggtctgtgattccacaaagatctgcgataactcatctcatccagacttgcaaaccggaaaccattctcatccggttcgctatgctttgccatgatatccatcgcaatcttcgccagatacagattcgtaccaattccagctgtcgccgtaatcccggtctgctcatagatttcccgcattatctttcctgcaagttcttccggtgtcagccggtaagtatgcagataatcggtaacatccataaaaacctcatcgattgaatagacatgtatgtcttccggtgcaacatacttcaggtaaatgtcataaatccgggtgctgtacttcatatagagtgccatcctcggaaccgccgtgatataatccagtgcaaagcttcggtctgcctttaattccccggtgtcacaggattgcccggtaaattcatgtcctccatttttccgctttcgctcgtcgttgatctccttcaccttccgaacaacctcaaaaagtcttgcccttcccggaatcccatatgctttcagcgcaggagaaacagcaagacagatcgtcttcgttgtcctctccggatcggctacaaccagattcgtcgtaagcggatccaaattccgttccttgcactccaccgaagcatagaaagatttcagatcaattgctacataactgcgtgtctgctccggcattcgctgcacctcctaacactttttgagagaacatatgttcttttcccaattatactatattttttcgccgaccacaagattacaactataaattttttattttttaagcaattggatattcagatccacatttccttcaatccccggcacacttcctgtactggaatactgccacatactgaacctatacggcgtctgcggaagttcttcataatctgcataccagaccggataatccaacagcttttccagatccagttcatacgcttcccacagcatattgctgtaaatcatggcatcatatcccgcttcttctatttctttacaaaataccttcgcattttgggtaaattgttctcccgttacaccatccgtccgtgcttcgtcttccagaatatgctctggatcgtacacaaccggcatctgaagctcctgccctttcaaatgttccagaacaaaatcagcctcttcctttgcctcttcttcatttaccgcctgcgagaaaaaataaacacccacgtctattccagcttttcgggcattttccatattctgttcaaacttctcgtctgcgtttaacgtaccttcttcaccatagccacgatatccgatccgcaaaattacgaactcatagcctgctgctttcacctgctcccagtcaatatctccctgaaaaacagatacatctacgcccagccttgaagtatatttcttatcctcatagctgatcttattttcattttttacaaaaagtgctttatcatacggattcttcgcaactgcttcattgatttccaccgtataacgctctccgtgtgcatctacaaaatcaagcgtatttttctcatctgtactttccgcattttttgcatccgcagaagtttctgctgttttctttccagaacatcctgcaagcaaagctactaacattccgaaaataatccatcttacttttttcatctattctccatttttcttcgttatattttccacagattctaaaatgtaaactgtgtattgctccacaaaaggttattatttatctcttttctcttcaaacctgcaagtgcaattttttatttcaaaacatctcatgttattgtttatccgaggtcaagtacggaacaataaccggaaaaggaaatttcaaaacatctcatgttattgtttatcaattacgcttacgtggcagtcaagtggtcagaagtatttcaaaacatctcatgttattgtttatcatctacactaggtacagtcggacaggcattgcagatatttcaaaacatctcatgttattgtttatcagctactgttgtagttatttcctcgttatactcaaatttcaaaacatctcatgttattgtttatcgtttggtatgatggaaagttagataatttaatagtatttcaaaacatctcatgttattgtttatcgtgccgaccactacaccagatagtgttttcccaactatttcaaaacatctcatgttattgtttatcattaatcgatgcttaaaattcttatcatctaaactcatttcaaaacatttcatgttattgtttatccgagattctgtgtcacaagctcatttatatactgatttcaaaacatctcatgttattgtttatcgatatcattcataatcgttgctgttgggtcactccaatttcaaaacatctcatgttattgtttatcttaagttgtatgtgttggtacagaacgccggtggttatttcaaaacatctcatgttattgtttatccatcatcctccgtatttattgtaaccggtgttcctatttcaaaacatctcatgttattgtttatcttgactgcctgtttaatatctttggttacaacaccatttcaaaacatctcatgttattgtttatcgggtttgctaaatcgtccctagggtctaacttgatttcaaaacatctcatgttattgtttatctgatgcaccaacaatgggatacgctttcttattactatttcaaaacatctcatgttattgtttatctactccaccttgcataaatagcacttcctttcatatttcaaaacatctcatgttattgtttatcacgatgacggattcctgaataatgcaaagaaagtaaatttcaaaacatctcatgttattgtttatcggacctgatcacaaattattgcatcgacgcaggcatatttcaaaacatctcatgttattgtttatcgatattggagaatttacaatcgatgccgttttggaatttcaaaacatctcatgttattgtttatcttagaaaacacaataatatataacagacgttagtcatttcaaaacatctcatgttattgtttatcgtgaatcaagcgggtgcattggacacttctcttggatttcaaaacatcccatgttattgtttatcagggaacgatgattctcttaaaagtaaaattgttatttcaaaacatctcatgttattgtttatccctcgcatttccgcgttttttagtttctcccctccccttttcccccttatattttctatatttctccattttttaccagccaacacccttatcctggaccgccctacttatcatcccataaatctcttattttttcaagctttcctggatttttcattctttttccgcctggtaaaaatcctataattatatcattaaactttctcctgttacctcccctccatttcccaaaacttcttctccaaacacattgtcattcatcaacttgataatgcaaataaaatcttcatccttgtctattacctggttcaaatccttccgcaattgtataaactttgatggcgtcatctctcctctaaatacagacttttgaaaatgtgaaagatactttttacagatcttaaacactttctgaactcgtttttcattcacatcataaaacaaaaatgcataattataattcaattctttcttctttttcattacatcccttctttcaatgaaaatgaaacaaattctttttcttccagtatatttttaatcagcttatagcaatccagcttcaatgccgtgcgatatgaaacttttcgttttaatttgggatgcataaatacactttccagacgttcttcaaatgactcaataaatatttttctgccttcctcatttaaaacacaatagtttacctgcttatcaaagtgtttttctacctgcaatctgcgattgtttaccaaatcaaatatcgttttaaatacaattaccggcttaaacacttcactgagatccaggcttaaagaaaatcttccttctgatggttcgtgaagaaaactgatcctttgatccagatgtgtctgataaattgcagcaattgtcttcgtatataacagtgtatttccaaaagaaatcagcgcattaattgggttatccggcggtcttttcactcgcttattcataacaaaatcttccggaagaaaatatacaaagtcgccataaaacctcatccatacttctccttcatatgccatcaactcttttacatcttcagcttgcactacctgtggaaaaaatgatttctttatccagtctattgtattttttacttcctttttcccatgtttatagtagtgataaaggacttcataaatatttactccaattccttttacaatcgcccttgctatatccattctgtcattctgatatttcactgcttgctttacaagtaattttccactcagataatgatcttttgggtaataagtcccactgtatccaccataataattgaaaaagtgaatgataatatgattctgtgacagaaagtccaacaactttgtgttaatacccacttcgttaaaacaataaatttcttttgtgttttccactggaatatatacattccttccatttttccgaaagcaaagcgaattatcctttctggtcagttctccaatggacatgatatatcttgtacttcccatttacatcctcccgattttaaatatagcagtattcataataagcacattttttgcatgtatttttatgaatacattctggcggtttctcttctgcgattagtgcttcaatctcctgaatataatcgaatagctgcttctccacttcatcagtaagttccagataaataatccttttatctttcttattcttctccacaaattctagctttcctttacgcagaattccttttttcttcaaaacacttaggtaatataaaagttgccattttgctgattccggatcagcatcggactttttcacttcaaccagatattcttttgtcagcttatccagacagatattttcaattgcaatttctgagttcgtactattttctgctctttcctcatgaatcgcttttccaatcttcacctgctcactgttatcttccagattcaaacgatttccatgcagatagcactgccttttgcagtgaaaatagtaattaatcaatgttccatttattctcacaggctcacctcatttcctaaataaacaagtccttcccctcttcaaacagctcgcgccttaaaatatcgttttcatcgaaatacgcttctccattttcaatataataaagctcaccaatctgttcatcctccataaattctgccttgcagctgaactgataaatgaatgcattcattttacttcgaacgttatgcagcttcactttgcgctcagaatattccatctctgtttcttcaattagctgtttatattcatcccacacaaaccgtccatcaatttcttctccattttcttcttggataatccttcccagataaacagatttcatcaatctgttatcattgattaactgcatccgcttatccaccttcggcatatcaagatttcctactgttttctggaaaaaatcttctatattttcatcattacatttctttttttccgccagtaccagcggaagaattccattttcataataggcaggaaagtttttcgcagtcaggagctccctcatttctttattcaccaatgttttatccttctcaattcttttgtccccactgtatattttctcagcattatccaaatcaaagaaatagacaatgcctgactttctccccgaccggttgattcttcccataaactgttcttcactgtccagtctggaaatatctttatagccgatatccatgtcaatatctacacccgcttcaactacctgcgttgcaaccagtataactgaatctaatgcttctattttccgaatcattctctttcgatccagaatgctgctgtcacctgtcattaaaaataccggtatttcacttttttcacataagattcgataacattcttcggcacttctctttctgataaattcaatcaaaacttttttatttttcccagctttttttacaatctcatccgtcagatattccatcgtcattttctgttccaacagactgtaatccgccacaactcttctggcaaatttcggatgattaaaatatttttctctgttttcaatcagacgtattgtttggcaatgattatctgtcagtatatcgagattcggcaacgttgcagacataataataattttcatctgcataagttccgcaaaaccttttaaaaatgtaataatttcaccccataattcatttttataactctgtatctcatctaaaataatcaccgaatgactcaactggtgaaatccaaatacatcctccttcgcatgtccaaacattgttctgaaaagcatgacatgggttgacaaaacaatcggataattcaggaactgtctgtccagtaaaatccgattccagtcatttccttcgtctctgtctttcattgggacgagtgaatttacaactgctacctgtgacatcaccctttcattttcaccaaaaatctttccgatgtacgtctccgatccgccattcggatataaaaatttcctttactacgcatttcttcggcaaaatacaatatatcggtataaaataatcattaaccactacatatagcgtttctacgtttttagacgcaaaaaataggccatcaactcgaaaattgatgacctaaatatcggtgcaaaaagctcacttatttgattattgaaaaaagcccacctggttcccgttcctgcctgctacgctttaagcaagccggatggtgaccaagtaggcttcttgaatttcggatattctatttttcagtgccgaactcttcctttgcttcgccacacgcccctcacatttccccactgtcggctttttcttccggggtgggattgttttgcgatggagagccttctgcccgacacagggcaaacgtggggcttaccgtcccgtccagcacttttccattttcaatcggcagtgcttcttgaatttgaaagctgaccaatctctgctctaggaacggatttccaatcatgcggtaagatctgcgcttatcccatttggcatttttataaaccattcgcacgaaggccacgcacttgatctcacagctgctgaactcattcagctttcccactcgatgagctcctgcatctgccgcactgcatacctgcacggcgatctgattcatttggggattgtataaaaaccgatagtgtgacggccagccgagcgtttcaagagtgctgcgaaaaatcgtgatccgtccttcatccacgtttaatgtcataccgagaacaccggcgtgccatattttctgttcctgcaatctactcacctcctcctaaaaatgggcgcacttcccccttggtttcttttcatccttctaatccgcactggtaccgggggccttccccgtcaggatgctcatcgacacatatccatctatttgcttcacttctgattctttcaggtgttcttctacaggcacgccaaaagtgcccgcaatatcatccgggtaaaatcccttcctggtatttacaggctttgtttcctctgattgtgacgcactttcccctttcttccgtttctgaccttcgtggaaaatttctggcacgagaaggtcaaaaacatacaaggtctctccttcaaagttgattcgataccccagtatcttatagcggcagtcactatcccagcccatctcgttataaaccaattctgaaaatggtttacaggacatctttctgctcttccgcttgtccggcttcgcaatacaccagcgcaaagcgtccttatcattttcatcacaaccacgtacaacgatgcgcttcaaatcactgttgaacatgacgtgtacataaaccacatcttccaatccactgatgcaggctgtgttgaatgtgatgctgtcttttcgaatcacaattgccgggtcccggaggtgagcgaacagttcttttcgcaccacttgatatccatcatatgaaaaagtgctctccagttcttcagcctttgcatctctttcagtctccaatgcctgctccttcggcggcattaacgttttgttttcctccatctatgtcaatccatccttccattatttcttccgcttcatggagcatcgtattcagaccatcggcggtaaaaatgttcatttcattaatttcagatgccggccggagcacatcccaattcccggcataatgttcctgctgcaaaataccaatctgtgcgatactcgtgatcggctgaccaaaagttcccgcccattccggcggaaaaatataaattgtctttttaactgtttcgccttctgattcttcctccttaggtggcaggacgatttcctccaccttgatcatctccggctcatccagttcaaagagcatcagcttatcgcctccctgctccacaagctgaccacggaagcggtacttcaaatcttcgtcccactccatgatatcaaaaagagcctttgccagtcctcgacacccaagggtacttgcacaccagcgtccttctttcaatctgccccagcggattgcattcggattgctcttttcgcacggccgaatggcaatacatctgtcaaccgaattcaataaaagctccacatactccacatcttcaaactttttcagacaggcagcattaaaccgcagccttccgtttgaaatcgtcatcgccggattctgcaaggttgcaaaatactgtgcccggactacttcatagccagtaagatccagacgattccttacttctaccgtgttggactgtttttcccacatgacgctttcggatgcttcccggtattcctctgccgaaaaacctgtccaatccttatcaaaaggcacatatccgcgaaggatgccatcatctacaacactcaaaactggcaacggatgatttttctttttatacgtccgggatgcgcgcagatgattggccgcattgaaaacatctctggaaacaatcgcctcgtgatgatcccgctgacggtactgcgttcgatcattgttgttcttctttgccttgtgtgtaaggaagtttggtgtgaaagtcttcctcgccaacacatccccacaatggcgttcgtttgcaatgatgccggcaatcgtgcccggattccattctgtgttcccaagttttgtcttccgctcgtaatctgtcaggagttccgcaatatccttcagcgaaaatccattcaggtacaggtaataaatgacctttactgtctgagcctcatcccgattcaccacaaggttaccatcctcatcctggtcatatccaagcaacgccggcgtaaggaaaagtccacggctgaaccggcgatcaatggaccagttcatgataattgatttggaatgggattcctcctccgccacggatgccagaatcgtcaggatcatgcgtccgttactgtccagggtgtagatattatccgcttcaaattttacccctacaggtgggtcaagattcttcagcgtttcgataacagaaaggcagtcaacgatatttctggcaaaacgggcgatggactttgtaagaatcaggtcaatctttcccgccttacaatcctcgatcagctgctgcattcctttgcggtgtgccagcgaagtgccgctgattccttcatcatcataaataccaacaaactcccagccgggttgtgccttaatgtagtccgtataataatttttctgaagctcatacgaggaggtctgttcatcattgtcagtggaaacacgtacataggcagcgacacgacgaatagaggtgctttctccaagcccctccacaattttggccgggataacctccagttcggaagtatccacgcctctatatcggtctctaattctctgcttacgatctatcgcttctgttccactgctcattctatagttcctctcattcccccggttttatgctccaataccactggcgcatcttccgataacttcggatgccgagttctttctttgtgttttctgctgttctacggctaataccttcatcgctcaaccgcatatagatttctctggatctcatatcatcttctgaaagcagcttcttaatcaggtaggctgctttttcagactttgattcaaatactggtgtttccggctctgctgccgggtcctgtgctatttcacattccagccattggaagccctgctccgctgttatcgaaaatttgatttctccatctgacggagccagactgttttttatctgccggacgatacggacatctgtgttctttggatctcgctccacctgcaggacactccgggcagccgccaccacatcaatactgccaaggctccgatacaggccttttgttccctcttttttattgaggtgaccgatcagcacaatggcgcaatcatatacagatgcccacataccaagacgctgcatcagctttctggctctgcctgcaatctgaaggtcagaatcacttccgagataagcctgtatcgggtcgatgactaccaatttcggccgaaattctataatagcctgccggatgcgttcatcatccagtgtcaggccactgtatgtttcttcatttataaaagccacattcccacaatctgccccacacttttccagccggggcttgatggtatctgacacaccatcttctgaacactggtaaatgaccctctgcgataatccaactgctttgccatccggcagctttccgcctttagataactctgctatcagattcatcatcattgtggacttaccatcgccggggtcgccttgcagcaatgtgatcttcccaactgctatgaacggataccacagccaacgaacagaagtcgcctgtacatcactatataatgtaagaatccctttttctcctttgctcgtcatcatcgttcctttccatgtgcagtcttttctacatttatattatagagtgtgtgtggcgttttgacctccatctgacaggtggagtgtacttaaaaattccatctagcagatggaaaaaagtgctaagaccacacagcagataggggtgtgggcttttgcggtcttaaactcttctataatcagttgctatgtgcattttcatgcgggataatcgtactgccttatgcgggattcataaggaggaccacacatggcaattgattatactgcacttggacagcgtatcgctgatttcaggagtaaggaaaatttatcacaggaagaacttgctttcagatgcggagtaggaaataagcacattagcaacatagagcttggaaagagcaagccaagtttggaatcacttgttcagattgcaaactttctgaatgtttccgcagacgatcttctcgtagacagtctggcacattcggcttccacttccgattccgagattcaccgtctgcttttggactgcaacacactggagcaggagattcttacccgaatggtaaaggaactgaaagcgattttatacggattgggagtatgattttgtaacccgttgaccacataacaaaaaagcccgcataagccacaactgcacttcggagcatgccggggtgctgtctgtggttcatgctggatgaggcaaaaaaagaagcccaccagcgtaccatgtaggattgattctacacagtgcgccagtgggctgaatatgtttactttcttataccgcctttaatggggctttacccattgtttctttgaactcatccaccgtcatatttgcttttgctgccgctatctcaatatcaagagttccatcctgaaccaagtcaatcagtgtaagaatcttgccttcaagaatactctcatttcttaaatcttccatctgcttgcacacttcgctcactcctttcgggttttctttaagatatctggttttctcagccattaatggaaaaatcatatcattagcctgggtacagttaaaatcatgcatcaatttaccaacatcagaatccccacgatactcgccattcacatatataatatgcgttccatcattaaatggttttccagttgtggtaattatattctgtacaggatataatggctggttttctccaaaataatcgttttctgttataaagattacataagtatctggtaagctactaaaatcctctcccgcatcaaggttctcaatgtccatcatgctggagtgatatctagcacggtgtgggtctgctccaatatctgctctttgaacttctatatcgtactttttccccattgaatccgtaccgtacgcatccaaaagaatagatttcgcacctgttacacgttttaaatcagcctgggtttcacaagaaaccaactgtaaatctttcttccctgttataatgcgcagcaccatttctgctaatggaacgttatttctaaaaaggcaacgcataaaagtatcatcaatcggtctaaagccacgtaaacgctgaagatcttcttggtgatgtcttttctttcgttcctccagtgtctcagccatcggcgccacctcctcaaagtgttttcaacgagagtgtataatactcctattgtattttcatgttaccataaagatgcccttttatcaagcagtcatctgtgaactttccagcaatttttgttggtcatcgtgtgtatttcaaaccccgatacgcatccagcacgaattccaaaaactggggactcatctgctccactatgctcttgccatccacattctccagcatggtcacaccagcttttgacaagtcatcttctctcttctccagctccctgatgctgtctgccacggccgcatcgatgaacgcagcgagctttgctccgtcaacattgctttgtataggcatcggtgcgccatcatcaccggctaaccggattaccttcgggtcaaggatagcctctacttttttaaatgcttctttctccggcatccgccgcagataccctttcattgcactcacaaccaccagctccctctgggtcgctgcataatcttctactgaaatccatgctaatctcttcatgtcgttctctcctgctatgtgtatttctgtactctcaacatatagcagaattttgcacatagcaatgggttcggaaaaaaaatcctccaaaaacaaaaaaatccccaccagacaagacagagtgtctcatccagtggggttcccaaaatcacgcttcctgctccagcaatgctcgttcttgtgctttccgtttccggatcatcagcgtgtgtgccgttttttcctttctcttttctctatggtaccgaatgcagagtccgttgacctgccagccgtccatcagcacctcgaccgttttattcggattgcatctgcggaatccgatgaaagccatcagcgtccggctgttgccggtgctggtcagcttgactccaaaattcgtcgtgtaggtgatcacatcaccgtcaacgattccttccttgatgaatgcgaagtaaacgcccttttcaaattccaggaaatccggagcctgttccacacggtctgcacccatctttctttttccacgccggatatcactcaggattttgcttcgtgccttgccgccaaagtcacgcaggcagcttccatctgtatccagaccattgacattcagcttcatgccggccttgttgatttcgggcagggcttccaggcagcggatgaaaaagtcgtagttgtgcttcatctccgaaagaagctgttcttcctggctgagttgctgccgttcgtccattttctcattcaaacgctctcgcagatcatccaccagtctttcgtaggtatcaatctccgggctggctttctggcggccacgctctactgcttctttcagccgcccctgcatctgagccattttttcctccagctgcagaatctgctcatccagttctgtttttctggaagaatcccgttctgcgacgtgctcctgcaccttctggtagatcatccggaattccgaatcgatccatgcgttctccccgttttcttcatggtcgcgcttgatggcgtacaacatttccatgaagctctgcttgaccgccgtctcgtatacaaaatgggaagggcactttgcatctccttcgccaatataaatcggatgccaggcaacatccgggtctgcttttcccataaatggcccatcgttggtcggtgaggtatcttttagacttgagcaccgccaaacgggataggtgtaataataccgttcatagtagtcatccggcgaactcccctgtgccaacagctcactgcggcaggcatccaggcacctgtcatcctcgaagtgcgtggctcttgcctgcagggttctgcggtaaaagggggctccgcattttccgcataccaggttatcaaagacatccttgcccactcgtttttcccgtttttcatccttctttttcgttcggtttttctttctgtgtgccaggatttcctgtgcccgcatccataccgcgcgattgataatcgggacatggtggtccgtcacataaaatttcggagcttctccattatttggaatcgtcttgtggctcaggaaatcgacggtaaccgttttctgcatttcgcagtcaccaacatatttttcattccggaggataaaatccacactttcgctttgccattttgttcctttggatgaagggattcccttttcattcagttcattgctgattttgtaagaagattttcccagaaggaactcatcgaagatgaaccgcaccaccctggcctgttcttctacaatgacccagtccttattcgtctcaccgtccgtatagccgtagaccgaccgtggatttccaaaggcaatcccttcctgaaaccgcttttgaatactccagctgatattcttggagatcgaattgctctcttcctgtgccaatgctgaaaggatggtcaggagcaattcgccagatgcatccagcgtatcgatgttctccttttcgaagtacacaccgattggcgggtcacactgccgaagctgtctcacgcagttcagcgtatcgaccgtatttcgtgcaaatcgggaaatggactttgtaatgatgtaatcgatctttccgtccagcgcatcctgcatcatctgattaaactcggtgcggtggttacggttggtgccggagattgcttcatctgcatacattccggcaaaagtccagccttctttttcattgatcagcttcgtgtaatagcttttctgcccctcatacgaagtctgctgggcaagctcatcggtcgaaacacggccgtaagcggcaacccgaatgtcctttgcctttttcagctgaccgccggccgacactctccgcttcgttgccggaatcacctgcacattgtttgcaaccgtcccttgtgtcatttgtctgttcatcaatacttcctccttatcatgccgggctgctgatagccctcaaatacgctgtcacactccacatccgtgcaggtgtcatcaaaccagtggattctaaaatgtttcggtgaaaaaatggtaacggaaagcacaaaggctttcacatacgttccaactgcttcatccagaaacatctgcgtccctcccgccagagaatccagccattgcagcgttttctcccggatttcataggtctgctccagcttcttccagtaatcttccatgtaccggacctgttcggcctgctgctgggcttcgtgttccagcttctccagctgttcctcttcgttgagaagtctgtcttctaattctgtgaccgcttctttttctatcggttctcccagcacctcacttctcacttttaaggcttctttttctgcctgaatatcccggatgtgctggtgggcatcccgaatgctatagttcactgcagacagctggcgtttcagaaaatccccttcctgctccatctggtcgaaatcatggatctctctcagcttctcactcagattccttaatgcctgatttctcacattatcaataggagctttggagatcatctgcataacctcatgaacttctgcatccatcttctcacccagcttgaatttttcggcaaatgccttgcgaagcagcgcctggatctgctcttcataaaccggctccatccggcagcgcttctgtccctgttgggcgagcttcgttgcacaccgccagatggttgtccttgttgtggaatggccttgaaaataccgtccgcattctccacacagcaggagtttggaatagttcctttcgtttcttcctttttcaatacccctgtactttgccgtgtataccttccagacttcctgtgcttcctgccacaattcttccgaaatgatagccggatgatgatttcgtatcaggtatttcggcttttcccccttattgaccttctgtttacgcccattcctgtgatcggtgtaggtcttctgacaaagtacagaaccgcagtaacgaacgtttgcgatcatgtaccgaacatccgttgccgtccacccccgcttatcttcttcctttagtgtgccagctggcagcacagttggcttccgcttttgccgctgtctgcatccgctgttcggcggctggatatgcatggcatccagcttctgggcgatttgtgtgaagcctaattcttcttttgtaaaaagtcggaacaccatccgaacaatctctgcttcttccgggatgatgaacactgcccggtatcggtatccgttctcgttcactgtatactcccctttgcggaattcgtatccgtagatatccttgttgcagacatttccggccggaaaccttttctgattgctccatgcaatgtttgctgaaatcgaacggctctcttcctgggcaatggcggccagcgtagtaagaatgaactcgctgtaagcatccgctgtatccatcgcttcccgctcaaacagaatcgtgacattgttttcctttaaggtccgtaatgccacaagaaagtcctgcgtgtttcgggcaaaacggctgatggacttacagatcactcggtcaatcttcccctgcttgcagtgccggagcaaacggttgaatcctgtccgtccttccctgcttgttgcggaaatgccatgatcggaataaatgccggcagatgtccatcccgcatttcctgccaggagtgacataaagtagcgttcctgcatttcatacgaatcttcctgtgccggattggtggaggaaacacggatatatgcggcgacccgaacagccttctcttggcttgctgctggcaccgtcggcattgccggccggcattcctgcatcacatcggatgcgagctgggagaagtcttccatactctccggctcattcaccggcatttcttttactggtgcatagctggttacgggcggcttctttttctcagccctgactttttgcatggcggcaaggatctgcgccaccgattcactctgttctgcctttttcttaccttttgcttccggcagcttcatctttgacataagatcattcagaaaagcatttgaatccatatcgtcctctcctttcgtcagattttccttccgaaaggaaaacgtgtggtaatgccaccgccttttcctatcttcgggtagtgacatatttgctctatccggcacttatagcaagtgatatccgaattataaatcgtagaatatccacccatataatcgggcaaaactgacgattgcgttgtatgtaaaaaggctctccttttcaggaaagcccatgaaggtcagatacgcgctgcgaagtcgagtgcaatccagcctgcaccggatttcagcttgccccagcctttcacagaaccagcaccagcagattctgccacgatggtgaacacgccctttccggtgtaataaccggtcttgccgtagtttgtgcctggtcctttacggatgttgaggtcattgatggatactcgaaccgcatacggcacagatgcagtctggttcacaggatagaccgccttgccggccggatcaaagaccgtataccccggattcgcatccgcgcactgcttcgcataggacagatcatggaacgcccctttctgggaagctgcattctgccagctcttacgcacacgataccagccagagatgttacctccctgattctgggctgaggcattatactgtgtcaggttccagcgttcgatgatattgcagagattctgcacataggtgtggctggtggcatagccgccgtccttgatgatctgcacagccttcttgtagtccatgcatccagccagaccttcataacgtttcctgctgccattcatcgcaccgagcagatatgccgcatggtcggcaatggagtcctccacacaggcgtactttcggaaatcagcggtgatcgtgacatagctgccatcggcattctgctcctgcgttttcttagtatagacagacttaccatcccaactgctgccactccagctgttcccggaaagagaggtcttcatgccaaagcagttatttgcattctgtgccagctcagatttaccatagccggactccagaataaactgcgccatcgacacgcaggcgaggatgccggactgcttctggttttcggtaaacagcgggccgatctttgccactgcctctgcttctgacaggttcttaagggaagatgcctgcaggcaggatgaagctgaaccgcccagtgccgccgtcacccttgcggccagatcacccagacgggcatacagccagtttccgggacagcttttgttggcaaaccagcgatgaacagtcaggatcatctcgtctgctgccggagcgtagttgagggttttattcttgtcgcccagccacagcagtttcttcttgccgttacgtttgcagatatcgatgcaaagcttaatgagcgagccatatacggcgctgttcatcgcatacggctcgttcatgtcgctggcacattcgatggtgactgctctctggtcattggaattgctggacgagcaccagctgcggttcttctcctccacgcacagagaaacacggccgtccgtgccaatgccatagttgcagctggcctgacgggtcgggctggtaaaacatccgcaaatgctctctgcagaaagctggcctaccacgcaatgcggcgtgatgcggtcaatgctgtgtgttctctgcccggaatggttcggggagagtttggtgtaaacaacgagtggactattggtgtatcccatatcgattcctcctaaaaaaaatcgagacccggatcactctgagtctcgtgctgtggttattttgttattttataatcccatccgcttcttctagcatcctacagacgaacttcatggcagacatcggtttttcgccgcctgtcccattgactttccacgctacgtttgcgatcgtagaaatggtgccgaggacactactcttcttagcccctttttgatttgcaacgagctgtatgagctggcctggtatcaggttcggctgatgccagtgcaggatgattgcatccctcagatattcgcagcccttgtaatacaatgtgatgccatacggtcttaacacatcttctgccatgagcacttcgttcattttcatcacctcagccctagtatacagttatgctgttgggaattgaagtcctaaaaaagcgtcgaaatgcaccgtttacgggatcagcagcttcataccgacccggatggcattggaagtcagaccgttcagtgcgcggatatcggcacaacggcttccatcccccagttccttctctgcgatcttccagaggttgtccccaggaaccaccttatagattttgcttgctgtaaatgcgtaggtgtctgcactgttcagaacataagccagaccacttgctgcttccgggcatttgatcttcagccagcctgcacagaattccacgatctcgatcagcgtattcttcttatagatggtcacaacctctgcactggtatccggcatttcccggatattcataagagtcttaagcttgccataggcgatcgctgccgggagttcctctgcagtcggatactcttcctttccggcttcctctttctgctcatccgtcaccggggtgtccttctcttccgaagattcctcttccggtgctttcccttccggctcatccataaccggcttttcctccgcttcctctgcacccgtgaccggcactgcctcctccgggtagatcacattgccgtcattgtcaaacacacggctgccgggattctcatcgcacttggcttttgcattcaccagcagacggtatgcgccaagctgggatgcttcatcttcccagtcctcacgcacacggtagtagccggtcgtcagctttgcgggatattctttcatactcatggtccgttcctcctaaataaaatgtgggagaggcttatcgcccctcccggttgattactgcttgtcgattttgtcctgatcgcgctcgtctttcaactgtgccagcatctccttgagcttctccggcaccggaagaccgatcactgctgcattctcgagacagctcagaccctcgtttgccagatagaagaacaccacagcggtgcggatggcggctccattctggaggatctgtgtgtcaatgatattggcaataccaaccagcacaaagatacataccttcttggcgatacccttaaagccaacttcagaagaaagctcatgcttgattgctgccgccagcaccccggtgaagtagtcacagaccacgaacactacaagtgcatacaggaagccgtcaaaaccgccgaagaaccagcccaggaaaccacccaggcccgcgaacatccattcaatcttgtcgatcacattctgcataattccgtcctttccgcccgtttgctaagcctattgaacaatatttatttggtaactagatacatgtatttatgtatctaaaagatattatacgagggagggaactgatgacacccgatgaagttcgcatgttggataaccgatatgcgattctttttattcgtggagaaagaccaattttagatgagaaatttgatattttaaaacatcccaatgtagggcttacgacagatggaaatggaaagccatatctgcatggagcagttgaccgggcggtggcaagtatctcactgggagacagtctggaggacgagtttgctgatgattcattagaaagtgaaggatacgaattattatctgatgaagatttggaagaaattatccagaaatatgcgtaaatcaaaaaatatataggaggctatcaaaaaatgaagttagatatgcgaaagaagcaggagaagaaagaaaccacaaaagtaacgaagaagctgccaatgacagcaaaaatgaaacgtgccctggcagtgtatattgcaatggtactgtttatgacagcaggagcaagtaccgtatttgcggcagatgatccactgaccgttatcaataatctgtccacatttatctttggactgattcgtgctatcggaatgattttactgggatttggaattgtgcaggttggtttatcactgaaatctcacgatccaagtcaacgagccaatggattcttaacattagcaggtggtgtgatcattacatttgcaaaagaaatcttgaatttgattacgggttaagaagaatagaaaaataaaagaaatgggacggtgcaggctcacatggagccgcaccgcccaggctaagacaggaggtgtttaaaaggtgtcagataactgggtagtacagaacttgcaaaatgccttggatacctggaacagtaaacttgcggaaatctggcagatactcacacagtcaccggaaaactttaagggtggcggtatctggcaggtgattgtgcagattcatggagcgttgcaggcgatcggctatgccttgttagtgcttttctttgtagtcggagtggtcaagacttgtggaagttttacagaggtaaaaagaccggaacatgcattgaaaatttttatccgttttgcgattgcaaaaggggtagtcacgtatggactggagctgatgatggcattattcaatatcatacaaggagtgatcagtacgattatgcagaccgcaggatttggaagtacggaagatgccgttttaccggacgaaatcatagaagcggtagaagattgtggattttttgaaagtattcctctatgggcggtgacgttgatcggtggactttttattacagttctgagcttcattatgattatgagtgtatatggaagattttttcgattatacctatatacagcaattgcaccgattccgttatcttcctttgcaggagagccgagccaaaatattggaagaagtttcttgaaatcctatgcagcagtgtgtttggagggagcaatcgtggtacttgcctgcattatattttcattgtttgcatcatcaccgccagtagtcgatccagatgcagcggcagtgactatggtatggagctatattggagaattgattttcaatatgcttgtactggtcggggcagtgaaaatgtcagaccgagtagtgcgggaaatgatgggattgtaaaaaggacgcccgaaagcgtccttaaaaatcattctataatatctccgctattgttataccgcatatttccatgagaatcgaaatgaacagaatctaaaggaatccctctttgtctggcacgagaaatctggaaggacatatcatctttcatagctttgtagtattgatgttcctgccatttgcatcgtagagcaaaaatccagctgagaacagaaaaggcagtcagcagatagaggattgcaaatgcaagtttctcatgagttgctgcccatggattcagaatcgtggaaacagcaaggaagtataacagtggtaaggtcagatttaatctggcagcaatccgaaacagcagagaaatcaggaatagagcaacggtaacaacaagtgaaatcataacagtgattggcataggtcagtccccctttcatttacccaaagtgtaacagaacaggaaaaatataacaaatgtgcgatttggaggtgtatcgttttggaagtaaaaattaacaaggaaatcagggattacacggaagcaatttttttcggattgtccctaagacagtttatcttttcaggattagcctgcgggattgccgttgggctttattttttgcttcacccatacatgagtatggaaaccgtgagttggatttgtgtactgggagctgccccatgtgtagtgttcgggtttgtaaaatatcatggaatgacagcggagcagtttatctgggcatggattaaatcggaaatcctgatgccgaaaaaactggtgttccggtcaggaaatctttattttgatgcagtagaatcagtcattaaaaaatatgagaaagaaagtctgaagaaggagggacgcaagaaaaaatgatgaaaacgatgagtaatatcttcaagcaggataaagaaaaatttgtaattccaagaagtgtacagcaggtaattcccatcgagaccatctggtctgacgggatatttaaaatcgggagaaataaatttgcacgtacttataaatttacggatatcaactatgcggtggcaagcaaagtagataaggaaaccatgttcctggaatatatggatttattaaattcgttcgattgcggtggaacaacaaaaataacgatcaataatcgccgcttgaataaagtggattttgaaaaagcaattctgattccgatgcaggaggacggactggatttatatcggaaagagtacaacaacatgcttttagataaggcaaccagttccaacagcatggtgcaggaaaaatatgtgacagtatcctgctataagaaaacgatcgaagaagccagaacgtattttgcacgagtgacaacagagctgaatagccattttgcaagattgggttccaaatgtgcagaggtaaatggagaagataagttacggattctgcatgatttttaccgtacaggagaagaatctggtttccattttgatattcaggagagtatgagaaaagggcacagcttcaaagattatatctgcccggatacttttgaatttgaaaaagattatttccgcatgggagatcgttatggaagggtactttttcttcgtgagtatgcttcttacatcaaagacgatatgatagcagaactgaccgatatgaatcggaatctgatgttgagcattgatgtgattccggttccgactgatgaagcagtacaggaagtggaaaaacgtctgcttggtgtggagacaaatatcacgaactggcagagacggcagaatgcaaacaataacttttctgctgtcattccgtatgatttagaacagcagagaaaagagagtaaagagtttatggacgatctgaccacgagagatcaacgtatgatgtttggaatactgactatggtgcatacggcagaatcaaagaaacagcttgacgcagatacggaaacacttctgacaatcggacggaaaaagttatgccagttttcggttctgaaatttcagcagatggacggactaaatacagcactacccatcggacaccggaagattccggcagtccgcacactgacttcggagagtgtggcagtgttgatgccattccgggtgcaggagattatggacgcaggcggtatctattgcggtgaaaatgcaatctcccataatttaattatgtgtaataaagaaaaactgttgaatccaaattcattccttttaggtgtgccgggaagtggaaaatcctttaatgcaaaaatgcagattgtattcctggcactggcaacgcaggacgatatcctgatttgtgatccagagcgagagtatgcatcattagttgaagcaatgggcggagaagtggttcgcattgctgcaggaagccgggaccatatcaatgcaatggatatggtagacggatatggagatggcggtgatccagtgattgagaagtcacagtttattttatctctgtttgaacagttggataaaaaaggaatcaatgcaaaggaacgttccattattgaccgatgtgtgggagaagtttatgaggaatatcagcatggcggagcagtgccgactttgcgagtgctgcgtgaaaaatttttagaacaggaagaaccggaagcacaggatttggcactggtatcagaattatttaccaatggaagtctgaacgcatttgcacatgaaagtaatgttgatgtgaataaccgtatcatggtatacgatattctggatttaggaaaacagttaaagaccatgggacttctggtaatcactgatgcaatgttgaaccgggtaacggagaactggaaacagggaaaacgaacccatattttcttagacgagtttcatgtagtatttgaaaatgagtattccggagcattttttaactctgcgtggcgaagatttcgtaagcgtaatgcattcccgacagcaatcacacagaacgtggaatatctgttagattctgttcttgcaagtacgatgatttccaacagtgagtatatcgtgatgcttaatcaggcagagccggacagagcaaaactggcaacactactaaatatctccacagaacagatgggatatatcacaaatgcagatgccggttgtggtctggtgaaatacggaagttcgcttgtaccgttcgtcaatagattcccaaccaatacaaggttgtataaactgatgaccacaaagccgggagaggacagtatcaaccggggaagaatgtaaaactaaaaatattttgaataatgaaaagcaacgcgctggaaatcgtcacaatttgtggcgtttttttagtgccggaaaaggaggcaactatgtcagaaatcagattttcatcaaaggaacacgaaaagtttttttatcagatgttagcaaaatgcggaaagcacgacagttattacagttcatttttttattgtgtgggaatttctgaagataccagaaatcatgttgatcgcatgtttgattttaaagagcgtttgattaaaccgggagcactgcatgaagggtggcagacaggtggttcggcacgattgaccagactggctttcaacttgtggaatggatatgtggagaagggagaagaaagtctgtctaccccatacgagatgttcgattgtggctatgcaccatatttttatgaagcaatccgcatgaagtatccggaatactgccgggaactgccacaggtgagcaaaaaagaaactaatcatgaacgctagataaagattcaaatggagaaaagcgatggattgtaagataaaaacacgccaagtccataaggatattaaagtattagataagacagttacagtgacagaccatgttaagcagtcctatgtcagaacaaaagaaaatatcatgcaatcgacggagaaatctagtgatagagagaataatccggtaggttatgcagaagatgcggccagcaagtatgctgaccgcatctttcacgaaacagggcatcaggtacgcagacaggcaggaaagattattgaacggaagaaagagaaagcttctgtttcttcgacaggcgaagaaacagtttaccagccgaaagaagaaattcgaccagtaccgccttcaggcggagaaacggcacaggagcagggaaaagaacttgctgtcaaaaaaattaagaccattgaacgggataaaagaaccatcaagaccgggagagcatcggaacaggttgtaaagaatactggaaaaggtactatcaagacctctggaaaagcggtcaagactgcagaacagacggcaaagaccagtattaagacatcggagcagacagcaaatgtttctgtccgggcaatgcattattccatgaaaaaagcagaaaaagcagtgcaggcagcaagacagacagcacagaatacaaagattgcagtgaaaacgacagcaaaggcagtaacacatgcaataaaagcgttgatggaagctataaaagcattgttaagtggattgaccgcaggcggttggattgcagtggtgatattgattatcgtcattttatttggtggatttctttgcatgacaggcggggataattccagtacggtttcttctgtcagtgcagaagtagaagcatatgagccactaattcggcagtatgcaaaccaatatggaattggtgaatatgtggaattgattaaagcgattatgatgcaggaatccggtgggagaggacttgacccgatgcagtgttcagagggcagttttaatacaaaatatcccaaacagccgaatggaatcacagatccggagtattcgatttcttgcggagtgcaggaaataaaaagctgtctggaacgtgcaggagtaaaaaatcctctggatatggaaaatattaaactggcattgcaaagctacaattatggaaatggatatctggaatgggcgaaagctagaggtggatatacccttgccaatgcagcagaattttctgatatgatggcacagagaatggagtggagcagttatggggacaagcagtatgtaccacatgtgcttcagtattatgcatttggaagaatcccgacaggtatcggcaatcaggcaatcgttcaggtggcagcatcgcaggaaggaaaaggcggaacgacttattggagatggtatggatttggaggcagggtagagtggtgtgcctgctttgtgtcctggtgtgcagaccagagcggttatattcagagtggagtcattccgaaattttctctttgttcggacggtgtgaagtggtttgaaagcaaaggtaggttccgtgacggaagttataccccggtggcaggagatattattttctttgactggggaaataatgggacgattgaccacgttggaattgtagagagtgtcagcggtggaaccgtcaataccatagaaggcaacagtggggataaagtggcaagacggagttaccgtatcggaagcagtaatatctatggatacggtgtcccggcatattaaaaggcaggagaaaaagtgtgatagtctaatggtgaatctggagtatacaattcctgaaaatagacttgacttttaaatattacaagcgtaagatttaagaaacaaaaaaattagaagaaaggaatatctatgaaaaatagacgaaaaaagcaaaatatccaaaaatcttacgcttgtaagatttttgggctgatagtagctataacagtaattgctgtttcaggaggtgttttattaaaaaggacgataacggaatcaccagaagacacacttgtggaatatatgaaccatattgaaaaaaaggaatatgaagtaatgtatactatgatagattcagatgaaaaagtttatctgacaaaagaagaatacatacaacgaaattctaagatatacgaaggaatagaggtcagtgacattaaaatcagtcatatagctgtgaaagagaaaaaagcagatacagttacgctttcgtatgaaacatcatgtaatacaattgccggaacaatacaatttgacaatatggcggaactgaagaagacgaaacagggatataaattagtatggcaggatagcctgatttttccagatttagagagtgatgataaaataagtgttactacatcaaaagcggagagaggagaaatattagaccgagatggtaaaatgcttgcaggaaaaggagtagcaacatcagttggcattataccgggaaagctggaagacaggaatgtatctattgaaaaaatagcggagttattagagatagatgtagaaacaataaataacaaactcacagcaaagtgggtaaaagaagattcttttgtaccaattgaaactattccgaaagtagaagaaatagatttaatgaaaatacagccagaagaaaagacacttgaggagcaggattgtcagaataaacttttggaaattccaggggttatgctatcagatgtggaagttagaacctatgagttaggggaggcagcagctcatttaataggttatgtacagtctgtaacagcagaagatttggaaaatcatccaggggaaggatattcagcagaaagtgtaatcggaagatctggggtggaaaagttatacgaaaagcaattaaaaggaaaagatggttgtgatataaagattttggatagtgatggggaagtaaaagaggttcttgcaagtatttttaaagaagatggtatggatataagattaacgatagattccgatttgcaaaaatcattatacgagcagtttaaagaagatccggggtgttctgtcgcaatgaatccttatacgggagaagtattggctttggtaagtaccccatcttatgataataatgaatttatacggggcatatcatcagagaaatggacatcattaaacgaagatgaaaagaaaccattatataatcgtttccgtcaagtatggtgtcctggctcaacatttaaaccagttgtggcaggaattgggttgaaaacgggaagcatagatccaaaagaagattttggaaatgaaggtttggcatggcagaaagattcgtcttggggatcttatcaagtgacaacacttcatgaatatgaaccggttattatgaaaaatgcaattatctattctgataatatttattttgcaaaggcagctcttaaaattggcagtgagaattttatgaatactttaaatgaaataggatttaatcagaatatgccgtttgagattgcgatgcaggaatcaacatattccaatacagataaaatagaaacagaaatacaattggcagatagtggttatgggcaagggcagattcttgtaaatccattacatctggcaagtatttatacttcatttttaaatgaagggaatatgataaaaccgtatttgaaatacaaagaagaagcatctggtgaaacatggatagaaaatgcgtttagcaaagaaaatgtagaagaaattatgcaaggggtggaaggtgttgtaaatgatccagaaggaaccggatatgctgcacatcgtgacgatattttgctggctggaaaaacagggacagccgagttgaaggcaacgaaagaagatacttctggcaaagaaatcgggtggttttcggtgtttacggcagataaaagcgtggacaaaccaattcttcttatcagtatggttgagaatgtgaaaggaatcggtggaagtggttatgttgttaaaaaggatgcaaccgtattggaggaatattttgaaaaataaaaaaatttttacggggaattattacatatgtaagaaaattgcgatgatattgatagttcttattgtttttacaggatgcggccaaaatcgaattacggaaaaagaagaaaagaaagaaaccgtagaatctgaaatgaatgcagaagtaaagaaaacagcgcaaacttttcggtctgtttatatgaaggagaagtcggagttaaatacattaaaggtgaaaagaaaaattatcaattgtctggaagaaaaaggatatgcggcagtagattgtgataatcagattgatatggtcaatcgtgaaaaagtagaagatttttgcaaaacagcggagaaagaagaacaggcagcagtagatattgtacaaccgaacagagattcgctacaatattaatatttctggtgataaggagatgggaagatgagacaatgtatggatgcagataatctgcaccaaagactgaagaaaataatcggacaggttcaggcaatcagatgtactggtatcactggcattgatggtcattgctccgactgccaggtcgccaccgtaccttgaaaagctggaggtgaaactgatggagaggatactttccgtggagagcatgacgaaagtggaaataccaagtgccaggcagggcaggataatgtctctgcgtaaccggaaattttctttccggagatggagaatggttttctttccggtcaggaaacggagaatccatacagctccgacagcctgacttaaaacggtggcaagtgccgcacctcttacaccgagatccagtataaaaatgaagattggatcaaggataatattgatcactgcaccaataacggtggtgagcatactgatctttgcaaatccttgtgttgtaatgaacgggttcattcccataacgatcagtacaaaaatacttccaaggatgtagatgcgggaataggcaacggcatatggaagtgtcttaccacttgcaccgaaaagggtcagcatctgtggggcaaaaataaagaaaataaaggtcagtataactgccatgataataagaagagaaaagcagttcccaaggatcttttctgcagtcctgttatcctttttccccatggaaatcgcggcacgcggagcacctcccgcaccggcaagcatggcaaatgcattgatcagcattaaaatgggtgtgaataaaccgacaccggtgagggcagaagcaccaactcccggaaagcaggagacagcaagagaagatttcaataacagcagaaactatgtataattatgttgtaggtacaaaaatagtgtgacagcgaggtagagaaaatggaagagcagataaaaaagatttatgaaaagcagaaaaatggacgcatcaggatgatacggaatgtgctgttgatttatgcagcattgatttgtgtggtgagtattttcaaaggaaatccgttcccgcatcaggagacagtactctttttcgatgtgaagcagccgggctgggtcacgacagatccctggcttctgtggatttgcgtggtggttgatctgattgcaggtatattcattttaatcagggacattctcagagacttttcaaaaattgaccggattctgtcacagcaatgtgatgcagaaaaatattcagaaatgctggaagagttgataaagtacggaaagagcttggattatcatggatttcaaaaaagtgtcatgctgatagctgagtctaaatatgtagttgcactgatcataaatgggcagttgcagaaggcagaagagtatataaagaatgaatgggaaggaaaaagagagggacgttcctggcagcaggtcatgacgaatctcgaactgtcgaagaaatatcaggagaaagatgcggcaggttattcggctacattagaaaaagcagggaaagtatttcaaaagaatccactgtttatggcaaaaaatttgatgctgaaaggtgaagatgaggcagcagtaagattactggaaaatgatacggaaaagctgccttattatgaggttacacgcagattcctgctgggagtatgttactaccgaatcggaaaagaagagcagggaaaagaatgtatggaatatgtaattgggcatggaaatacgttgaagtgcaaagaagaagcggaaaaatatgtaacagtgtaagtaaggatgttctttaaaatgacagggtaacaaaaatggagaagatatagaggatggtaataaaataggatatatcgcacataaagatggtgaatctggagtatacaattcctgaaaatagatttgacttttaaatattacaagcgtaagatttaaggaacaaaaaaattagaagaaaggaatcggtggaagtggttatgttgttaaaaaagatgcaacagtattggatgagtattttgaaggataaaaaaatttttatggggaattattacatatgtaagatatttgcgatgatattgatagttcttattgtttttacagggtgcggacaaaatcgaattacggaaaaagaagaaaagaaagaaaccgtagaatctgaaatgaatgcagaagtaaaaaaaacagcgcaaacttttcggtctgtttatatgaaggagaagtcggagttaaatacattaaaggcgaaaagaaaaattatcaattgtctggaagagaaaggatatgcggcagtagattgtgataatcagattgatatggtcaatcgtgaaaaagtagaagaattttgcaaagcagcggagaaagaagaacaggcagcagttgatattgttgttgtatttgatgaaggggaaattatacaatatcatttagagtcaatgaatggaaagataaatgttcgattatgtcaggttaaatggaaagataatagtccacaggctaattattatgatgaatatgaagcatatgagtggaaatatacagaaaaaggatatttgtttctggaggaatatcacccaccgggatttgatggagcaccgggtgaaactggattcagagtgcagccattagataaaacatgccgggaattgaatcgaaaatatgttatgccgttggggtatgtacttaataatctgttgattacaaattgggataaccagaattatacggaacttgatttttatgatctttatgaaaaaatgtattatatgaaatatggaaagcaagttccatatgaagcaaattatggtggagtagaatatgaagttccagaagatgagtttgaagaggttataaagacctatttaccatttagtaataccgagattgaaaagggaactttttataactctaataataaaacttttagatacagaccgcgagggttatatgattgtgaattcccatatgagccatatccggaagttatctcatatgaaaaattacaagatggaacattaaaacttacgatagaagcagtatgggaaatcagaatgttagatcaggcaatcaccagtgaattgatgataaaacctatggaagacggaagtttccagtatttatcaaataaggtaatcagttcagatcaaaatgcaaatgcagggtggtatatgccaaggttaacagaagaagagtgggaagagaattacagtaataattagggggcaatatgaaaagaaaaagtattttgttagtactttgtataggaatgattctgacttcctgtgaaagtaagatatcgttaaacagcacagatgtaaaaaatgagaagaatcagaaaaacactaccatggaaaatccggataagggatataatctaccaatcgatgaagacaagaaaaaggaagttgtgaacgattgtgaagaagttatgggcattgtccgagacatttattctgaatataatggaatacaagaagcagatcagaacactgctgagcaaatgatgaatcggatgaaagaaattatcaaacaaaatgggaatccggttattggttccgatcattattctgttatggataattatcagaagatggaacaatttttaaaatctgcagaacaagaagaaaaaggaagtgtaattttatatgaagcagatacagatggtggaattaccagaaaagaatatagttatgatggaaaagaaatgagtgtgatgtccgcaaaaatgatctggagtgaggatacagagcctgtacttacatacatatcgctatcaaaaataaaagaatgggcatatactgaaaatgggaatttctgttatgaattatgcgtacctgaaccaccggaagtgacagagattgtagatggaagttgtattatccgggtaaagcctttgagtgaggagtgtcgggaatattcaaaaaaatatgtgagtacgttcggctatcacggaaacaatctgttatgttcaaactggaatgcggaggatatgcaggggttggattataatggactttatgaatatttttatcaaatgaaatatggagaaaaatttactgcagaaaaagaggttgtgggaattccagcagaagagttcgaaaatgtaattatgacatatcttcctgttacaaaagaagaattgaaagaatgggcggtctacgatgaacaaagtaataggtttatctgggaacgattgggatatggtaattattcaccaacacattttggcttgtctttaccggaagtaacagaagtcaggcacaatgaagatggaaccattgttttgacaattcatgcagtatgtgattctgttgtatgtaatgatgttgttattacacacgaacttacgatgaaaattcaggatgatggaacgattcagtatgttggaaacaggattttagataatggtattgataatataccgaggtatcagtaccggttaggtaatttgcagaattgatcagtagagaagaaataaataaagagaactgataacgggaaattatgctatcagttctctttatttatttccaaataccaagattagaaagtacagattttgttatttcggtagcctgacttccagttgcaccagaagaggattgaatatttgttgcgaagtagtaagtattattcgatgtttcaatgtatccgataaaccagccattgacatccttaccattgacacgcccggttcctgttttcccgtaaagagaaccggaagaagtagtggaaagcagcagagctttttttactgcctggatatttttactgtcaaaatgaaaattattttgatagaaatcctgtaacaattccacctgttctatgggtgatatcttcagagagaaatctgtccaatagagatttagatttgttccagtattctgattcccatagtttattgtctgtaaaaatgttcttacggcttcaaaacctgcctgtgaatcaattgcctgaaaataccagtttacggaattatgtatagccgaggttaaatcttgatcggcttcccatgaattaaaaggatatggttctccattccatgtgaaagtggaatgttctggtgtaataattccagattccaagccaagtaatgcatcatatattttataagtcgaattcggtgatacacgtgtggaagcatgctccatattataaatattccatttatcagcagactgatcatataaaacaaaacttccagtgtagtccccaaaattggaagaaagatttagctgagtaatattcttttcggttgtgtcaaaatgatacccagtctgatcagaagcataagcagaaagtatgggaatgcatccaatgatgatagtagagacgaatatgcatataagatatccacgaattttttgtttaaaagtaggttggtggaatgatgcaatatttaaaatgcgtccttttaactgttttatatttccactaattcccatagtaagagggaatggagacagagctattgtttcggcaaagttaatcagtgtatttccatatgacttgtattctgtttctttcaataattgtaatacagcactgtcgcaggcaagttcccgttcctgtcgtattctttttagaaaataccagattaggggattgaaccagtagaaaacatttactgtatttatcaaatatccaattagaatatctttatgcttgtagtgctgcagttcatgaagaagcatatagcgaatatcagttgcgcttatagttccagcgttaaaatctgaaatcaagtgaattggaagataaatgcgaggatgcaggaaaccagccaaaacaggagatttcaaaaatgctgtactataaatcggaatggtatgcttgctgttcacttcgtttaaacattctatataaagagcgtttagttcttcattttgaagaggtaaagcagaactatgtaaggcttttacttgttttactgagcggtagagaagaaaaaacattatgaatataccgatactccagaaaaatacaagtaatgtgtgaataaaagttggtatttgggtgctgacagagacagcaaaatcatttattttatccaaattataaccattaccagaaagaaaagtggtttgaatgtcaccattggtacttgaactggctgtcagcaaatgtctccacgatatagaagatggggcagagtttatcggtaaaaagggaacaattagaacggcaagaaatataatcgaaagattatattgcatacatgcggataattgcctttgcaataaattttttaatcccagtaaactacctaaaaaaatacaaatgatggcattacagagtaaaaatcgaaaactaaaatatatcaaaatatgctcctcccatggttaatgattggaaagaagattccgtaagctggcaatgtcttcttcagacaatttatcatcctcaatgtaagaggcaagcatagaagtgatattaccattataatatcgctttaaaaaagaattactttcctgccgaatatattcgtcttccttgaccaatggagtatagacaaaaatccggctttgtttttcataggttagtgcttttttagaaacgagacgtttaatcaatgtctgaattgttttaggactccaactggaaatttgtgttaatttttcagtaatttcattggtgctgattggtgcgtatttccaaacgattttcataacttcaaattcagcttctgaaatttgaggcagattgctcatgtgatattcctccaaatcttacaaatgtaataaaaatattatatatcttaaaaggttattctgtcaacgaaataaaaacttgactttaaatcttacagatgtaataatagataaaaattacacttgtaagatttgaaatgtgaaaggtttttataaaaatgggaagggtagttgttgtaacatttgatgaaaatgaggaagaaaaattaaatgaattattacattttctgtctgctaaaaaatactctgagatgcctgataaacaaaatagggtacttgattacggagcattaaaaataaatgcggaatatcgttctgtagaaagtaatggtgagctggttcaattgacgaattatgaatttgaaatattatatttgctggcaaaaaatccaggacggatattttcaaaggaacaaatatatacacaggtgtggaaagaaccatattatggggcagaagataatgttatgggcataattcggagaatcagaaaaaagattgagccagattctgcaaaaccaagatacattttaaatgtatggggtatgggatataaatttaatggtgaattgatgaaatgatggaatataaaattgggcataataagtaaagataccaaaaaaagcaggagaaatttttatggaaaatgatatttggaatgaaatatcctcttttttgaaccagttgcgttgtgagaatataaacagagaaagttatatctatttccaagaacttgcaaatattcagttgaagaagaaaatggaaaaagaaaaggtgaataaacttctcgatcatataagttatgaggacagggagaagttgaagcaatatggagaaattttggaagaagaagcgtttgtgtcagaacaaagggcatattgtcaaggatatgtagattgtattcagttattggctggtttaggactcttgaaaaaatcgacggatatggaaaaaataattagcgagatgaaaagcaattaagtgtgtcgtggaggaaaatgtagtatttgatagataaaaggatgttcgtaaagaagaaacagttatgttatatcaagttgtaatgatatagcataactgtttttaacatatggtaatagtatttattccactaattttaaatatcggtaattatcagctatttatcggtattttacaagttttattttgtatcattagtagtgtctacgttagaaataaaaggattagaatctagcagagctgtcgtagttgcaagaattacctgtaactgataatcattgcattgatttaagagccgaagaatctgatcatatgtagaattatttttattttgatttggataaacgtagtcatcagcagaaatatttaaagtctgcatggttttacaaaataattccagactgggaccgcctttatggcgttcgaggtctccaagataagccgccgatattccgagtttttcagcaagagcttcttgtgttaaatgcatttccatacgcccttgttttactaaagtggcaaataatgtttttggaatatccatgtttgtatacctccataaacttagtgtattacccaaaatttgaaaagtgaaaagggtgtaacattagaaaaaacacagggtattacccgatgaatgagaaagcatacaaatctctttcggttaaaaaaaacagattccgaaagagcagtatttgtatgcttattttcttttccggaatctaaccggagaaaatatggttcttagcaagagttcagctaaaaaattctgttcaacagaaggtattcaattaaaaaaatctcaacaatttcattagtaaatgttggaattgaaactagggtaagagccaataatgaatccagggtaataaaatatcgaattaaatgcgtccataggagtgaaatctgtcagggcgttttttgttacctaaatattgagaatgagcaattcaaaataaggtcgattgttcgtattcgtgccccgcctactgatctgaattcaaaaaaaaatcagattggaggaaaggtcatggaaggcagacagcctaaaagaagaaaagataaatataacccatatgaaatctatgagaaggacggaaaatattatgtttcatttcgtaatggtgaaaaagagtacaaggatttggaaataggaaagaatgtatatgaagcttttaatacgtttgaattgcaggatgtgtcgcatatgaatgttgtggacaggcatctggaacagtcagaaatctgggattccagtttatatgaacggatatttcagaaagaagaaaatgtagagaatacggttctgaataaactggaagcggaacggttacatagtgcaattcagcagttgtcggaaattcagagaagacgattgatgaagtattattttgaagataagaaatatgagcagattgcacaggaagaaggatgctcttttcagatggtagcaaagtctgtaaaagcagcaatcagaaatttgaaaaagattttgagatagtgggttgaaaaatagcatttaagtgaggaaacaggtggaaagagaaatattttgatccacctgtttcttcttttgtcacgaaaagactggggagcgggaagaaccttgacaaattcatatacattcatcaggcacattcctgttgttatcgtgatgagcgtaagccacattaacaaatacgccataacacaggctgggtaaagacagcgaaatcccacccgtatacttccttttggtttcagtttgtattacccggactgttgagcgaaaaatatctggttataactgtcagattgcttctggcagggcgatgacagacaacaggcataatgatactcctgtccggtcataaagtcgtgtatacaaaatatttctttgatgccgcaacaagtgagggcagcttcaggagatccctggagaggaaaactcccaatcccatatatttattttagataaaatcctgtggagctgattagcagtcagccgtctgatgatttcccaattacaagtcggggcgtcggggacaaataggcttgtattttacatatttagggataacaacagttagaaagacgagaggagatatagcaaagatggaagataggaacgtcaagcgtggggatatttatcacgccgaccttgatcctgtatttggaagtgagcagggcggttatcgtccggtgctggtgattcagaataatataggaaatcaatacagtccgacagtaatcgtggcagcaattacaagtaaagaaaaaatgaaactgccgacacacattgcagtcccggaaatggaaggtttggaaaaggattctgtagtgctgttagagcagcttagaactttagataaaagacggttggaaaattatgtgtgtaccttagaccgcactgaaatggagaaaatcaataaagcaatcaggagaagtaccgggataccgaagataattgaaaaaccgttagtcgtgagcctgtgcagagtatgtgcaggcaatttttatgatgtgccgggacattatatccggcgagtgaatccagaacagcgatataaggatacttgtatgttctgtaatgtccggaatgggtacgactattatataggaagaaagaacaagtaacacgtaaaagtcaagtgtgcgatttgaaaattcgcacattggacgatgcagacgaaaatggatatcttagtggtgtaacgtttttagatgttacacagctaaaaactaccggtagtgaagcgcaaagattaggacgaggaggataacgtcatggcaatgatagagaatgaagtggaaaagaaagtatataaagtagaagatgttcagaatttgcttgggctgggacgctccatggcgtatgaatttatagaaaatgtttattatgatagaaaaccattccgggtgttgaagattggcagatcttatcgtatcccatgcaattcttttgataggtggctgaatggagacgaggagagagaaagagtgagagccgaatgaaacagaaagaaacgcagcaggagacaatgtcaaaggaaaagagagttgtcttttttgaaggaaaatcatggtatcacagaaccaaagagctgcaggacgatctgacgacaaaatatgggaaaaaaggtggatttgaaacgccggaagaagcagagaaaagttactgggaatatgaaaagagataccagaagaagcagagaaatctccagattgcaaaaatgcaaaagacagatgtgatgcttggggattatctggaatactggtttgaaaatattttcagtccgagaattgagacaaccacaagaatggttggagcatataccttatataatctgattcttccgagtatggaagcggatatcaaattaaaatacatttcagtagagtatttagatgctctactggaacgtgtcgcgaaaatttgtccttcagcaggaaataaagggcgagagcttttgagcatcgccatgaaagatgcagcaggagataagttcataagctataatccaatgcctgagacaaagccatattcgagagcaaaaccaaaggtaagggtattaggcaaagaaaaattgaaagtttttcttgaagctgccagcaagaatccttggtatctagaaattttactgggactgttttgtgggttacgaaaaggagaaattcttggattgaaatttcaggattttgattttgaaaaacagaccgtcagaattagcagacagcttgttggaaacctgaaactgaaagaaaaagaatttacggttacggaatatgctgttattgaaaggaatccaaagactgagaacagctaccggatattgagagtgccaaaagtggtgatgcaggaagtaaaacgcagacagcagttgattgaattgcgaaaaactgatccgggcatagaatacaagaattttgattatgtatgttgtcaggaaaatggcgaaccccgatcattaacggcaatgaatcaggcacttacgaaaatctgtaacagaaatggattggcaaatatcaccgtacatggactcagacatatgtttgcgaccattttaattgaacttggagttccattgtttaaaatatctggtctgttaggtcatagttccgttcatacgacttacgaatattattgtgagattatggacgagcaagataagattattgcgtttgtaaataatacatttgtaccacaacaaaccggaacggagggatagccatgcataagacctttgactttaagaaatatgtagaatataaggtctattcggtgacaacaatcaaaaagggatatggatttcgtgtgttgctgacgtttgcagacgaaagtacaaagacgcagcaacatgcgggattcacgaccaaaagagaagccaatgcatttcgtgatgaagtcattggacagctacataccggaacctatattgtgtatgggaaaatccgggtagaggagtttatttctcaaaatgaggaaaacgggactgaaagaaatgtacatcgtgagatatgcagatgatttcagaatcttctgtcggaataaagaggacgctatgagaacaaaagaagctgtaacagagtggataactgagaggctaaggctcgaagtatcgccggagaaaacaaggatagtcaatgtcagaaaacgctattcagagtttctcggattcaagatacgggtcagaccaaaaagcggtaggtacgctgtgcaatctcatatctgtgacaaaaagttggaactggaaaggcaaaagctggtggaacaagcgaagcggattgccagaccgtctaaaggaaaaagacctttagacgagataaggctgttcaattcaatggttctgggaatacagaattattttcagctcgctacctgtatcagtattgattgcagaaaaatccacaggcaggccatgacagttttaaccaaccggctcaatacagaaaccgggtgcaaacttgttcgagaaggcggtgcaatgaccgagagcgaaaaggagcggttcggtaagtcggcaatggtgcggtatgtatcaggaatcgaccaacctatctaccctatcgcatatatcaagaacaagataccgatggcaaagaaaacagcggtatgcagttatacggccgatggacgggcattgatacacacaaacctaagcctgaactcatttgttctggcgggattgagaaatcaaccatctatgggtcgaagcacagaactcacagacagcaggatttcattattctctgctcaacgtgggaaatgtgcgctaagtggagaactctttgaaaatgcggctgacatcgtatgctggctgaaaactccggtagaatttggcggcagggaacgctatcaaaacatgattttgttccaccggagattccttccgcttctgcaaagaggcccgatgaatgagctgaaaacgatagctaatgctctcaaaacaacaaaggaactgatgttaaaagtgaacagtctgcgtgagcgggctggtttgtccgcaatagaataatagtatttcatttggagattgattaaatgcttgtgaaaacaatcgatggaacgccggatgcggtgaaagtcgcacgtccggtgtgaagtgggggaaaatccggcgataacctcaaaggattacctatcactataggcagaaaccctgctctatacggcactgatcggatatatctattatgaggctccggcaaacgaacagaattttgccacactggtagaaatgctgaacgcaatggaagtccgtgaggatgatgagtcgttcaaaaatgccgttgaccttctctttgacgcgctggaacagaaagacccggatcattttgccctgcgtcaatataagaaatataagctcgctgccggagaggtatgctctaagtgacttcttaatcatggtttttgtcatggttagtgaagcagtcacttagagcattttcatttcaggaggtacagccatgagaaacgagaaaatcaccccactgtatgagcgtttgagccgcgacgatgagttacagggcgagagtaattccataagccatcaaaagcagatgttagaggagtttgcccgccggaacgggctgccgaaccccacacacttcaccgatgacggcgtatcgggaacccgctttgaccgtcccggctttctggcgatgatggaggaagtcgaggccggacgggtggaggccatcgtcataaaggacatgagccgcctggggcgcgactatctgaaagtcggccaggtcatggagattttgcggcagcgcggtgtccggctgatcgccatcaatgacggtgtggacagtctaaaaggcgatgatgattttacccctttccgcaacattatgaatgagttttacgcccgcgacaccagccggaaaatccgctccgtgttcaagtccaaaggcatgagcggcaagcacctgaccggcaccgtcatttatggctacctgtgggacgaaaagcgggaacactggcttgtggacgaagaagccgccgaagtggtacgccgtatcttttccctgacgatggagggctacggcccctatcaaatctccaaactgctgtccgaggcaaaggttgaaatccccgctgtccatctggcacgctttgacgaaggagtaaacaggacgaagccggtcaaagacccctacggctggggatcatccaccattgtgaacatcctgaaaaagcgggaatacctgggccacaccatcaatttcaagacccgcaagcacttcaaggacaagaaaagccactatgttgacgaaagcgagtggacgatttttgagaatacccatgaggccatcatcgaccaggaaacctttgacaatgtgcagcgtatccgggcaaatgtcaggcgttacccggacggctggggcgaggcccatcccctaaccggcctgatgtattgcgccgactgcggcggcaagatgtatgtccatcgcgtcaataacggcaagcgtgacccacagtttacttgcagccagtacagcaaaatcccatgcgggacgctctgcggcacacagcaccgcatccgggccgaggctgtcctgaccctgataaccgatatgctccgggccatcgcggagtattccaggaatgaccgggccgagtttatccgcaccgtccaggaaacgcaggccgcccaacagaccgccgacatctccaagaagcggaaacggctggccgccgcccaaaagcgggccggggaactggaaaagctgatttgcaaaatctatgaggacaatgccctgggcaagctgccggacgcccggtatgaggccctggacgcacagtacgccaaagagcaggacgctctcaacacggaaatcgcggaactggaaaaggccgttaccggctacgagcagagccggaaatctgccgagaagtttatagccctaatcgacaagtacgagaacttcgacacgctgacaaacaccatgctcaacgagtttgtagagaaaatccttgtccatgaacgcgcccgcaaaggcagccaggacaccacgcaggaggttgaaatctacttcaactttgtgggccggtatatcccgcccgccttgcagccgcttcccctgaccccggaggaacaggaagcactgcggaagaaggaggaacgcaaggacaggcttcaccagaactacctacgccgcaaggcaaacggtaagcagaaggaatgggaagaacgctacaacgccaggcgcaaggcccaggtggaggcggcaaaggccgcgatccgggccgaggatatggaaaaaggcgtttttatccccgtcagccagttacccaagcaggagccgcgcaaggcagctttaccggccagcgccgcagtttaaccagcacagtgcaaaggaggacgaacatgaacgaattgacttacacccgttgcggagattactacatccccgacctgaaactttccgagcagccggaggcccccatcggcaagtatggccgtatgcggcaacgctacctgaaggaacaccggcccggcctttacagcagcttgattttgagcgaaaagctgtacctgcacctgttggaggttgaccgggaggcgcgtgaacggatggacgccatgctgcctcgcatgatggaggcggcgggcgtcactgaagaactgaaagcccgtgaccccatgcgctgggtgggactgatgaacacgctgaaagcgcaagcggaagaaattgtgctgacagagctgatttatcaatagctcttttacaagcggaggctgttatttgcggcctctgcttgtttttacgctttcgacatatctcacgccttgtattcttcgagataatgaaatataatagtagatgttgtcggaggtgcaagcatggactacatgacactcaaagaggcaagcgagaaatggggcgtttcgtcccgtcaagccaactattactgcgtcgatgggcgtattcccggcgctgtgaaaatggccggtgtttggctgcttcctaaagatgctgtaaagccggtcgatggcagaacgaaggaagggagagcgcagaagtgagtcgaattttacttttagaagacgatgaagcgctggggcgtggtatttgtatggcgcttgaaacgccgagttgcaccgtcacacattgcagcacatgtctccaggcaatcaatattttgcagggcatggtttttgatttattgattttggatattaacctgccagacggcagtgggctggaactgctgcgaacactgcgacagaatggcaactccacacctgccattttgcttacggctaatgatttggaactggacgaagttaccggtctggaagctggggcagatgattatattaccaagcctttctccttggcagtgctccgggccagagtaaatgcccaactgcggcgctctgtcccggtaaagcaggatcggatcgaattgaacggtttcatccttgacttcacacggatggagttttccaaagaagggacaatcatcgacctttccaagacagaacagcgcctgttgcgcctgctggtggagaaccggggccgcacgttaccaagagaattgctgcttgaaaaggtgtgggacggcggcgagtttgtggatgaaaatgccttatctgtggcggtgcggcgcctgcgtgggaagctcgggaatgccccgatcagaaccgtgtatggagttggctacacttgggaggtaagcaaatgacagctttgacctgggtgttgctggctttcgctgtcattgggcttctatttgggctctggcaatggacggcccggcgcagaactgttcagcggctggataatatgttggaacagtctatttccagtggttttaccgaggaacattttgatgaaacagaactgtctgccctggagacaaaatttgctcggttcctgcgcggctctgctcatacgcaaaaaacgatgaaaaccgaacaggaagcggtgaaaacactgatctccgatatttcccatcagacgcgcacacccatcgcaaatttacttgtatacgcttcgcttttgacggaaagcgatctgtcgccgcgtcagcgggaacaagtccaggcgctgctaacacagggggagaaactatcatttctgattcagactctggttaaggcttcgagattggaaacaggtattgtggttccaactcccacactgggtcctgtggctcctttattagaggcgactgtcgaacaggaaagacctgcggcggaaaaaaagaaaatcaccttgcagaaccttccgtttgtaggcgatgcctcctttgacccgcgctggacaagcgaagcccttggcaatgttgtaaacaacgcggtaaagtacacacccgctggcggaagggttaccgtatctgcacagatgctcgaaaccttttgccgggtggacgtgacggatacgggccccggtattccagaagaagaacaaggcgggatttttaatcgtttctatcgtggtgcatcaactcactcggcggaggggcttggcctggggctttatctggcacgggaaatcctgtcccttcagggcggttatatcaaagtatcctctaaaccaggaaacgggagcactttctcactgtatttgcctcgtgcgttgaatcggatatgaagaacagcaaatctttcaactctgttagatttgagaaagagtcaggaaagaattatgtggtaaagtctgtattgtcaaaaagcaatgcagacttttttgtggaggtatacaagatgacgattttagaaaccaaaaacttaaagaaatattacggaaaaggagatacgcaggtaaaagcactggatggtgtcaatctcagcgtggaggacggggagttcgtagccatcgtgggcaccagcggctccggcaagtccaccctgctccacatgctggggggcctggaccggcccacttccggctccgtcaccgtggacgggaagaacatcttctccctgaaggatgaggcactcacaatttttcgccgccgaaaaattggttttgtatttcaaagttttaacctggtgccggtgctgacggtgcgggaaaacatcgttttgcccatccagttggatggtggtaaagtagatgagcgctatgtaggtgaggtagtcaccgccctggggctggaaaagaagttgaacagcctgccggggcagctttccggcggccagcagcagcgggtggctatcgcccgtgccttggcgaccaaacccgccattctcctggccgacgaaccgaccggaaacttggacagccgtaccagccaagatgtactgagcctgatgaaggtgacgggccggaaattttcccaaacgatggtcatgattacacacaacgaagaaattgcccaactctctgaccgaattgtccgcattgaggatgggcggattgtaacacagtaaggggggagagccatgaaagtttcaaatcgaaaatgtgttcgccatttggcgtggaaaagcctgctggcaagccgcacgcgcaatctgattgccattgtggctatcgccctgacaacgatgctgtttacttctctattcaccatcgccttgtccatcaacgatgggtttcagcaatccaattttcgacaggtgggcggcttctcccacggcggatttaagtacatgacccaggcgcagtttgatgaactgaaggatgatcctctcatcggccagtggggcgaacggagatacctgggtatgcctagggaggcgcctttcaataaagctcatgtggaggtgagctttgccgacgccaacgaggcccactggatgtactgtgacccggtggaaggctctttgccgcaggagggcaccgaccaggctgctaccgacacccatgtactggaactgctgggtataaagccggagatcggggccgagtttaccctcacttttgacgtagatggacacgaaaccactcaaaccttcaccctctgtggctggtgggaatacgatgaggccattgtggcgaaccatgtcctgattcccgaaagccgggtgaacgaaatcctggcggaagtgggcgtagatcctgacagccctgatgacggcatgacaggccggtggaatttggacgtgatgctgaaaagcggctcccgacatatcgagcgggatttgaaccaaattttggaaaaccgcggctaccagagcgagaccgctggggacaattacattgataccggcgtcaactggggctacaccggggcccggatgtccgacattgtggaccccatgacggtcatggccgttgccggggtaatcctgcttatcgttttcaccgggtatctcatcatctacaatgtgttccagatctcggtggccggggatatccggttctatggccttctgaaaaccatcggcaccaccccccggcaactgcggcggatcatccgtctgcaagccctgaccctctctgctgttggtatccccatcgggctggtgatcggctggctgatcggcgggcagctaaccccggtgattgtggcccggctcaacgggattatgccaatgacctctgtaagcccctggatctttgttgtttccgcggccttcgcactgctgacggtgctgatctcctgccggaagccgggacggatggcggccagggtctccccggtggaggcagtgcgctacaccgaaggcagcagcgaaaagacccgtgtcaagggccggaaggcccgaaaggtcagtcccttcacgatggcctgggccaacctgggccgcagcaagggaaagaccgtggtgacggtgctgtcgctgtcactggcggtggtgctgcttactgtgacggtgaactttgccggcggctttgatatggacaagtatgtgtccaacttcaccgccagcgatttcattgtggccaatgctggaaaattccagaccagcaccctgttcagtgcggaacaggccgtgccccagtccgtcattgatgacatcgacgcccagggcggcatcacggacagcggcgtggtgtacggccagacctctcctgttctggagtacgtcaccgaggactggttccggcagaataaagagcgcttttacaccccggaacagctggacaacctgatccgcctgaccgaccggaacgaggatgggctgctggccgaccggatccagctctccggcatgagcaatttcgccctggaccacctgacggtgctggagggggacctgtccgccctctacgagccgggcagccgggccatcgccgccgtgtacgccgaagatgactatggaaacgcggacctggactcccactgggcccggctgggggacacggtgaccgtccgctatgtggaggagacggaatatgtggacccggacaccggcatcgcctacgccagcgtggaggacgtgccggacggggccaactgggtggagcggccggtacaataccgggacgtggagtacaccgtggccgccctggtgacggtgccttccgccctcagctaccgctactatggcagtgatgagttcatcctgaacgaccagaccttcatccaggactccggcacggacagtgtcatgtactatgctttcgacacgaccgatgaagcaaacgcggctatggagtccttcctcgcggactacacggagaacgtcaacccggaactcgactacgagagcaaggcaacctatgccggggaatttgagagtatgcgctccatgttcctgctgctgggcggtgcgctcagtttcatcgttgggttggtcggtgtgctgaacttcttcaatgccatcctgactggcatcattgcacgtcagagggaactggcggtgctccaggccgtgggcatgactggacggcaactgcgcgctatgctgatctgggagggattgctgtacgctctgggggcggccgggctggctctgattttgacgctgacgttggggccggtcaccttccaggcggtggaaggattattctggttctttacctacaatctgaacctcacgcccttcctgtttatcattccgctctttgccctgcttggggtgtgtatcccggtcctcaccggccacgcgatggcaaaacacaccgtagttgagcggctgagaatggaataaaaaatagctctgtattcactgccggacgacggcaaaagaaaaaaagccgtcgtgcagcagacaatcatcacgcccaaaagggaacggcggctttgagaaaatcaaggccgccgttcccttttgccctcaacaaaggagtgacgcccatacgctgacacggcggctttaggagggagccgctatgaaagaacttgtccgccgacaaattcagacgatatttgcactatcgtcaaaaaaagcccagccaccgaaccggccccgtctggcagccggtgcgaaaattgtcacaatgtaactgaataccgtattttttgcgctcgaatggcttcatgctgtccgggcgctttttcatacctgtggggccggaacatcgggtcggtatggcctgaaccctgtccccggtgccgctccccgccgccccgttcagatttttccgcaaaaaatctgaacggaggaaaggcagatggaagtcaccatccattacaacggacaagctgcggccgtggaggtcacgctggaagtctatgaatttcttgaccgggccgaccacaaagccgagaacctgtcccatgagcagcggcggcactgggatggccgggagtttgacgaatacatagttgccaccgagggcgtgggtatctacggtgaaacgccggaggattacctttgccgcaaggaaacactggatgagctgatgaccgtcctggacacctgcaccgaggcacagcgccgccggttcctgctctatgccctggacgggctgagtttttcggagattgctgccctgtgcggctgctccaagagttcggtgcaaggctccattgaagcggtcagaaaaatttttcaaaaaaaattgagaaactacccatacgaatgaccccttttcgggctaccaagtgaaagggattgtttcccttatcccagcgggaggcggacagcggacaagctgcccgcctctcccattttcaggaggtaagcctatgaaaacaatcaatctgcggtggatttatccccactaccggcatgacgagtttgtggaggtcagcgatgaagtttgggaggtcatgcggcaggcccagcgcaagatgaacaactatgagcgccggaaggtctaccaccgcgcctactattccctggacacatatagctggacggagaactacgcgctggaacacggcagatcgccggaggatattctggtggagcgcgaggaacgggccgcccatctgcgtctgctggccgccttgccggaggccctggcccatgccacccccactcaggcccgccgcgtccgggcctactacatcgccggtatcaaccagccgaaaattgcccaaatggagggtgtacacagcagcaaggtcagcgttgccatccggcggggcctgcgtaatatacgccgctgctatgacggccttttcccggcagagtgagggcgggcctatgcagacgatcaacctgaaacagtattatccgttctgcaccgaggacacctttgtagaggtgtcggatgaaatcgccgaggcgttcctgctggataaacgggctgaggccgccagggagcgtaagatgtaccgctacaaggcgttttactcccttgactgtgacgacgggatcgagaaagccgccatcggctgggcgcagccatcgccggaggattgcctgatggaaaaggaggcacaggccgaatatgccgaactgctcaggcggctctatgaggccatttcctctttgcccccagcgcaggcccgccgcgtccatgcccggtatatgctggggatgaaagtgaaggacattgccgcgatggagggcattaccccatcccaggcggggaagtccatccatgcggcgcttcggcggctgcgccggtacttcatgcgccggaaatggacaagcggcctatgaaaaccatcaacctgaaaaaatactactacccgatttgcaagaaggacacttttgtggaagtgccggacgaagttgtagacgccattttggaggaaagccgcgcagagaacgcaaatgacgccaagcagcactatcactgttattctctggacgcttcccccggcatagaaaaccatttcccggaacaggtcatttccccggaagatattctgatggagaaagaaacggaacgggaacaggaggccgcccgcgccctgatgatggaacggctccgggaggcccttgccacactgacgccccggcaggcaagctgccttcatgcccgcttttgggagggcaagcagtttaaggagattgccgaggccgaaggcttcacgacatcagcggccattgtcacggttcgcaacgccattatcaagttacagaaatattatatcaggcgcggctggatgaagccgccaaaggagaaagcgatatgcacaaagaccacaccacccaagcgaaacagaaaaagacgagcgcgaagaagtcctgaaggaaatccggcagcttgagaaccgccagaagattttggagaacaaacagcgcaacgaggaacgcaaggcccgcacccgccgcctgattgagcgcggggccattttggagggtattttccctttggcccccggccttcccggcatagaggtcaaagcgttcctgattgccctgtcccatcttccgggggcggcggaactggccgcaaaactgccgaaatccggggacaagccgtaagtccctttgtttacaagggcgcacttatacaccgttgccggtgtcgtgcgccctgccgggggctgttgcgtacttcgtccgcgatggggagctacactccccaaaccccttgtgcgccacaggccacggaacatccgcaagcggctgtcccgtcccctgcggcctgaatatccctcaccgaaaggaggcgatccccatagatttttgccatatccccgtcagtatcatcaagcgcagcgagggccgttccgctgttgccgcagccgcctaccgcagcggaaccaagctgacgaatgaatgggacggcctgacccatgattacacccggaagggcggcgttgtccatgcggaaatcatgctgcccgcccacgccccgccggagtttgcagaccgctccaccctctggaacagtgtggagcagatcgagaaagccagggacagccagcttgcccgtgagattgaggcggccctgccccgtgaactgtccagggaacagcagcttgcccttgtccgggcctatgtgaaggacaactttgtggacaaaggaatgtgcgccgacttcgccatccatgacaagggaaccggcaacccccatgtccatatcatgctgaccgtccggcccttaaaagaaaacggtgcatggggcgcgaagtgtcgcaaggcatacgacctggacgagaacggccagcgcatcccagacgggaaaggcggttggaagaaccaccgggaggataccaccgactggaacgacaaagggaatgtggagatttggcgggcggcatgggcggcctataccaaccgggcattggaggccgtcggtcagcctgccctggtagaccaccgcagctacaagcgccggggcattgataaaatcccctctgtccacctggggccagcagccagccagatggagaagcgaggcatccgcaccgacaagggagaagtcaaccggcagatcgccgccgacaacaagctgctgaaagaaatcaaggcccgcattacccgcctctacaactggtctaaggccgaggccgagaagctggaaggccagcagcccagcatgatggacttgtgggaggcccagcagcagctcaagcggcctgacacccgcaccggaaaaatccgggcattgcaggagagcgccgccctgttcaattttctgaacgccaacggcatccaatccatgcagcagctccatgaaaaaattgccggtatgaacacccgctactatgacctgcggcgagagatcgtcaaggccgagcgccggatcgctgtcctcaccgagcgcggggagatgtgggcgcagtacaacgagtacaaggccattcataaacagcttgccaggatgaagccggaaaagcgggagctgttcgagcagcgccacagccgggagctgatcctctatgacgcggcagaccggtatctgaaggaactgaaagccagcggagaggaactttccccgaaggaatggcggcgcgagatcgacctgctgaccgcccagaagcaggtggacagcatcgacatgaaggccatgcgggaggaactgaaagccgtggaacggctccgcaaggccgccgaccaactggcccgccaggaacgggacaagccccgcgaccggggaccagagcggtaaagggtacggcgctttggcgacccctttgaggtgcgtcgcgtttcacgacacccttttacacacagaaaaaccgccgtacaggtttcacccatacggcggcagacggtttatttgccgaacaagtcgctgtgcgacccggtgcgggcaagcgtcagaaccagcacatcatcctcgatacggtaaatgagcagccagtccggaagaatgtgacattcccgatggcccacccaatcgccggacagatcgtgatcgcggtttttctccggcagcggttcacccatcgccagcagcgccacgacctgctccagcaattcaatcttcaggccgcgcttgatcgcccgtttgtagtccttcttaaagccggttgtgtacttgacggtgtactttgttttcctcattttttcaggtcggcaaacaactcgtcaaggtcattgaagccctttacagacgggtcttttgcaatcctttccgcttccagcatggcagcaatcgtttctttgttgggctgttccagcttcacttcaaagggaatgccgccctcacgaagcgactggcgcacgaagatgttgaacgccgtggataaattcatgccgagttccgcaaacagggcgtcggcctgtgccttcaaatccgcgtccatgcggatactgatgtttgtggtatttccagccatatcatcaacccctttctgctggtacttttagtatatgccatttgcacgaagaaaacaatactttgcacgaatatttaacagtaaattcattgaaggaggtcactgtatgaagcagattattttacccgtcactgtccacctgaatatccgcctgccccttgccctgttgcagccggaaccggcagacgcgcccaccggcccggagccggaggcccatgcctgccacggctgcgacaactgcggcgggtgcgggaagtgccagcatgaagaaaagcaagcctgaacccatccccgtcatggactaccgccagtaccgcagagcgcggcggctggtacatgagtgctgcaactatgacggcggcaactgtatcgcgctggacgatggggaggaatgtgtctgcgtccagtccatttcctactccctgttgtgccggtggttccgggcggcggtgctgccgctggacagagaactggaaacggccctgttccaccgcctggacgccaagcggtgcgccgtctgcggggcgctgttcacccccggctccaaccgggccaaatactgcccggaatgtgccgggcgcatgaagcgtatcaaggccgcccagcgcaagcgcaaacagagggcgaaatgtcacgctttaggggccgaaaaccccttgtaaatcaaggactttttcgagggtgtcgctgggggcctgatagatttatcctccggcccccaaaacggccctctaaatgcgtacagaagcccaaaacgaacccaaggaggaacccatgtcagacaatcgaaaatattactatctcaagctgaaagaaaacttctacaacagcgaaacgatggttattttggagagtatgcaggatggtctgctgtactccaatctgctgctgaaaatgtacctcatgtcactcaaaagcggcggtatcctcatgctgggcgaccatctgccccacacgccccagaccatcgccacctttacccgccatcaggtggggacggtggagagggccttgaaggtgttccttgaatttggccttgtggagattttgaccgacggggcctactacatggccgacatccaactgctgatcggccagtcctctacagagggggaacggaaaaagaaagagcgtatgcggttgaagcgtcaaaaactgctcccatccggcgaggtggacatttgtccaccatatagccgaggggacatttgtccaccagagattagagataagagattagatattagagataagagtatagagaatagagagagtgagagcgcccgcgcctatggccgttaccagaatgttttcctgacggacgaggaactggcagacttgcaggccagctttcccaccgtatggggccaatacatcgaaaagctgtccgagtacatggcctctaccggcaagcggtatcagagccacgccgccaccatccggcgctgggccggtgaggatgcgaagaaagcagccccgcccacccgcaaccgggattacagcgtaaaggaggatgaaaccgtatgatggagattaccgcagaaatccgggcgctgatcgacaaggcagccgccggtatggaactggccggggacgagtacatagacccggcagacggcctcattcactgtaagaagtgcggcggccagaggcagaccgttgtgccatgctttgggaaaccgggctacttcatgccccgctgtatctgccagtgccagcgggaggccgaggaacagcgcaaagccaccgaggaacggcagcgccgcatggagcgtatcaagcgccggaaggcccagggcctgcaagaccgctatctgtacgactacacctttgccaacgacaacggccaaaatcccctgatggacaaggcccgcgcctatgtagagaactggaaggaggcatacaaaaacaacaccggcctgctgctgttcggggatgtgggaaccggcaagtcctttttcgcaggttgtatcgccaacgccctgcttgaccgggatgtgccggtgctgatgacgaactttcctaccatcctgaaccgcctgaccgggatgttctccgaggacagggccgactttatcgccagctttgacgagtacgacctgcttatcattgacgatctgggtgtggagcgcagtaccgagtatgcgatggagcagatgtttttcgtcattgacagccgctatcgcagccgcaggcccatgataatcaccaccaacctgaaactggccgaactcaagaacccgcccgacctggcccacgcccgtatctatgaccgtatcctggaacggtgcgccccgatcctctttgccgggaaaaacttccgagaggaaaacgccggggccaccaagcaggcggcgaaagacattgtgaaccgtaagagcgactgattgttttgccggacggcgcagccccgcccggagaaaggagcgccatgaacgaagaaacccgtgccatgcagaccgcagacaccactccggccagagcgccggaggatgcccccgcgctggtaaagaaaatcggcaagaccacctacaaggtgcgcgtccatttcagccagaccagcaccgaaaccatgagcgacaaaatcaagcgtatgcttaaaaacgagatacagcagatgtgaccggctgataaagccagccgccttgtgttaaactgatgatggtacacaccaaaacttttagccaaggaggacatgaaaatgctgtacacagaaaaagagaaaaatgagattgagcgcgtccgcaaagtgtttgagaaacatatccagcagatgaccgcttatgatttggtttggtcggacaaggtcggctatgtgtggctggcaatatctatcgacccggtctatatcgacaccggcaactggatagagtccgctgccggtctttgttatgagtgcttgaatgatatagcactggatgttttcggaatgaccggaaacgaccatgactttgaggacgccgacccgctggaactggccgagattaagcggcgctggaaaccctatatcgaccaactgccggaatatgcgtacctttgcgacgaactgctaagcggccgcaagtaactctactcgcctgagtgtcaggagcatgaaagtgcttctggcactttttttgtggcctttttgtgaatttgattaaaaagtccttgacaactcgtttcgggaaaaacagccaagtcgatccttatttcctgtgcttccagactggctccttttgacattaaagaagtcagggaaattaccatgtatgacgaactggatctggatatgctgggagatgaacggactgctcttttccttattatgagtgatacggacgggacctttgcatttttgatcagtctgatctattccattttgtttaaccgcttgtgtgagcgggcggatgatgtatatggtggaaggcttcccatccatgtgcgctgcctgatcgacgaggcggcaaatatcgggcagatcccgaacctggagcgtcttatggcgaccatccgaagccgtgagatctctgcctgcctggtgctgcaggcgcaaagccagctcaaagccctgtataaagacaacatggacaccatcatcggtaactgtgacgcctcccttttcttaggaggcaaagaagaaaccaccttaaaaagctggaactccctattggggaaagagaccatcgacctgtataacaccagtgtcacaaagggcaatcaggaatcccacggacaaaattttcaaaagctgggaaaggatctgatgtcggtggatgaactggcagtcatggacgggggtaaatgtctgttgcagatcaggggtgtgcggccgttcctctcccggaaatacgatataaccaaacacccaaattacaaactgctttccgattttaatgagaagaacgcttttaatatcgaaaagtttctttctacccggatgccgatgcgtcccggtgaacgataccgcaattatgaagtcacagccgaagatctggcttcccagactttataaagttgttcctgcctgtcaaagcatgacgccctggcaggctttgtttttgtcacgatgaaaggaggattttttgaggattcgtgattctccctgaaaagtaaataaccgcaggatttttcctgccccatgccgccgtgctgtttgaaacagattttttctaaaaacagtgcggcggctttttttgtttccggcctgatacggccatatcacaaattaaaatttctgaaattaaaggaggaacattatggcattttttgcaagcgcgattgatactttgaagatccttgtgatcgccctgggcgcaggtctgggcgcatggggtgttgtaaaccttctcgaaggttacggaaatgataaccgtgcgacacgttcgtaagtgaaaagcttacgcacaaagtcgaagggcaattgtagcccgaaactttggagaactgatattccgattggtgaaatgagggggtaacgtcccgaagcgccaccctaatactccgaatggcggggagcatgcaacggctctctccaaaagtttatagagctcggtgaagtcggcagagagcaaccgtaagactggttttcagaccagacacgaaagctgtccagaggtggatggtgttgcctatatgccgggggtcggatatccatggtgagaatgtatgaaaatactgacgaaattctgaatgtacgagtctaaacgttgatgctgtcgaaaggcagtacacccttcatggtggtatctgtgggcgagtaaaattggttgttatgaaagtccatgcatcgttacaggcggtgcggttatgcatgaccagatacaggcttagaggaagaacctaaagatatccaatgataggaatatcggaacgtggaaagctgggaacacggaggcggttgcaagccagtgatgtggtggatgggaataccttcgcgagagggcaataaccattctttattccagtgagagtagtggcacagtacctgtgaagccgtgaataagtaagcggtggagggatagccacaagtcgaattcagcaaagaaaatgaaaacacaacaaacacagcttcgagtatgacaaagaaaatccaaaccgaagggagaggatgcctgtgttgacttcggggcagcaagaaaggaaaagtaaacagagaaaaatccgcaactcagagtattacgacatggaaggtacttttgacaggctgtatgcagaaagtaagaaagataaaaccttcaaccatctgatggaaatcatcgagaatgaagaaaatatcaggcttgcatacagaacgataaagaagaatacaggaagtgatacttcgggagtggataaaaggacgatagccgaccttgcaaagttaagcgaggaagaatacgtccgtctcatacggaaacaattcagtaattatcatccacgacccgtaaggcgagtggagataccaaagcccaatggaaagtccagacctctgggaattccaactatcgtagatcggatcgtacagcaatgtattttgcaggtcatggagccgatatgtgaagcaaaattcagtgagaactccaacgggttccgcccgaaccgttccgctgagactgctattgcgcaatgcatgaggctgatacaggtacagcatctgtaccatgtggttgacctcgatattaaaggcttctttgataatatcagccatacaaagctgattcgtcagatatgggcattgggaatccgggacaaaaagctgttatgcattataaaagagatgctgaaagcacctgttgttctgccagatgggaagaaaacatatcccgcacggggtaccccgcaaggcggtattttgtcgccattgcttgcaaacatcgtattgaatgaactggattggtggattgcctcacaatgggaggagatgccaacaaaaacaaaattcaaaacgaggagcaatgcgcagggaacagagattaagagccacgcttacagggctctgcgccggagcagattaaaagagatgcatgcagttcggtacgcagatgattttaaaattttctgcgcaacacatgaggatgctgtcagagcatacaaggcaacagagttatggctaaaggacaggctggggctggaaatcagccctgacaaatccaaagtagtaaatctcaaaagacagaattctgattttctcgggttcaagctgaaagttcgtaaaaagggtaagaaatatgtggttcggtctcatatgagcgataaagcatacaaaaaggctcatgaaaaagtctcggaagaagtaaagaaactggctcattcgtcagatgataatgctcagttcatgcagcttcagaaatataactctgtagttgccggacttcatgaatactattgtatttctacagaagtatcccatgacttcagcagacttgccttcagtatcaacaaacagctcagaaacagactgaaaggagacttatccaaaaagggacagctcagaaatgggttcattaaagaaaagtatggagcaagcagacagatgaggttccttcatggacgtccggtggttccactgggatatgtccagtcaaagaatgcccagcataaaaggaaatccatcaataaatatacggtaaaaggtcgggaacagattcataagaatcttgcaatcgacacagcgacaatgttatggctgatgagaaatcctgtaaagggcagaaccattgaatatgcggataaccgtatttctttgtatgcggcacagtatggtaaatgtgcagtgacaggaattccgatggattcccacgatattcactgccaccataaagtgccggttagcaatggcggttcggatgaatacgcaaatcttattcttgtcagcaaagcggttcatatccttatccatgcttcttcagaacttacgattgagaagtacctgaaatccttaaatcttgacaataaacaaatagaaaagcttaacaaacttcgtattatggcagaaatgccacctattattctttgaatttaatgctgtaacgaagtgtgtaagttgtgtttaaaagccctggacggctgaattcgatggagcgccgtgtgcggtgaaagtcgcatgcacggtgtggagcgggggaaaatccggagataacttcaaaggattacctatcgctatcaggtgcaaaatcccaggggatcaagcagttcatggctaattaaagggaacaaaaagaaaggaaaagccaatccagacggtatcagcggcaggctacaagaataaattgtgatttcacaagattggtgctataataagagaaaaggcagcacctctcccagattattgcaagacttcttgacggcatctccaattcttttgccagatgttccaaccagatcctgtagttctgactgcatcttcgggaaacagaagcgcatacctgggcgagtggtgcataagtatactccatttctcccgcaagctgccttatcactctttgcagctctccggtatccgtgatctgcctctgatattccattcccctgctgtatccatagccggatgtcgccgccacaattcccaggcatccgaccattttcagatacacagtttttctccccgttcgttataaatcccttcaatttctcctacatgtttcccggatttcatcacaacatatctggcaaaacatctttcctttaccagattgctgaccagtggcttttcacggatctcatccataccggaaccatgcaccgtcgtcagcatggttgccccacagtgcatggcgtactcgatcgcctctacatccttcgctgtcccgatctcatctgccgcgatcacctccggcgccatagaccgcaccagcatcatcattccttctgctttcgggcagttgtccaaaatatctgtccgcatcccaagctggttctgtggtacgccacggtagcatcctccaatctctgaacgttcatccaccacacccacatttcttccttccacccagcggttcccatccgaaatctgccgcaccagatcccgcaaaagtgtagtctttcctccacctggtggggaaatgatcatggtatggcaaagtcttcctttttcaaggatcacaggaaacagcttattcgcacaacctgtaatctcatggcagattcggatattgatcgatgtaatatactgaaaattccggatctgttccttttccgaaataattttcccggaaattccgacccgatgccctccttcaatcgtcagaaacccctggcgcagttcattttcataggcatacagggaataattggatacatattccatcgtttcacgcagttcttcttttgtcacccgatgggtaaaaagttcttcctttccctcttttttcactgcaagcggctgctcttcccgaagccggatctcctggatcttctcaaaatccagtccatgattcaacaggatccctcggattttctccggaagcaccgccagaatttgatctttcttttctcttctcatcttgtccacctctctttaaagaatgtatatggaaggcaggagaaaaatagaactaaaaaaggactctaccgatactggtaaagtccttctgattttataaaactttattctgcaacatctttgatgctgaagctcaaacgtcccatcttgtcttttccaaggcaaaccactttgacgtgatctccgatagaaagaacatcttctacatgatcgattctctgcttagcgattttggaaatgtgtaccattccttctttgcccggtgcaaattcgatgaatgcgccgaattctttgatgcttacaacatcaccttcaagaaccattcctgcctcgaagtctgttacgatggtagcgatcatctttcttgcctgttccatgctgtctgcatctacgccacagatagatacgcttccttcatctgtgatatcaatcttaacgcctgtcttttcgatgattgcgttgatggtctttcctctctgacctacaacttcaccgatcttagccggatcaatattcatctgaatgatcttcggtgcatacttgccaacctgtgctcttggctcagcgattgtcttagccataacttcatccagaatgtaaactcttgcttttcttgtacgtgcaattgcttcttcgatgatcggtcttgtcagtccgtggatcttaatatccatctggatcgctgtgatacctttatgtgtacctgctaccttgaagtccatatctccgaagaaatcttccagtccctggatatctgtaagtaccagataatcatcgtcagtagcacctgttaccagaccacatgagatacctgcaactgcagatttgattggtacacctgctgccataagtgacatagaagatgcacatacacttgcctgagaagtagaaccgttagattcaaatgtctcagatacggtacggatcgcatacgggaattcttcctctgacggaagtaccggtaccagtgctctctcagcaagggctccatgtccgatctcacgacgtcccggtcctctggaaggtcttgtctcacctacagagtatgacgggaagttatagtgatgcatatatctcttggatgtctcagattcatccagtccgtctaccttctgtgcttctgaaagcggagccagtgtggtgatggtacagatctgtgtctgtccacgtgtaaacatagcagaaccatgtactctcgggatcaggtcaatttctgcggcaagtggacggatttcttcgattgcacgaccgtccggacgcttgtggtctttgaggatcatcttgcggacaaccttcttctggtactgatatacagcttcaccaagtttggcaagccattcttcgttatcagcaaaagcttcttccagcttttctgtgatcttacggatattttcttctcttgtctgcttgtcatctgtgaatactgcaacttccatctcttccggtgttacgatcttctgaatcgcttcaaagagttcttccggtactgcaaagcttacataatcatgttttggttttccacattctgcaacgatctggtcgatgaatgcgatgactttctgattcacttcatgcgccgcgaagatggcttcgagcatcttagcttccggtacttcatttgctccggcttcaatcatgattaccttttctcttgtagatgcaacagtcagtgcaaggtcagacttttctttctgctctgcggttggattgaataccagttctccgtcaacaagtcctacctgggtagaagctgtcggaccatcgaacgggatatcagaaatagcagttgcaatcgctgatccaagcatagcagtaagctccggtgagcagtcctgttcaacagagagaaccaagttctccaaagttacatcatttctgtaatccttcgggaaaagcggtctcatcggacggtcgatcacacggcaggtaagaacagcattttctgatgcctttccttctctcttgttaaatcctcccgggatctttcctactgcataaagcttctcattgtattcaacgctgagcgggaagaagtcaattccttctcttggtttgtcggatgcagttgctgttgaaagcacaactgtatcaccataatgcataagtactgcgccgttcgcctgtttggcaactcttccaacatctacgcggagtgtacggcctgcaagttccatttcaaactttttgtacataaatgttctccttttttatctgtttatctgacgggtaaaatctccgaaactactgaaaaatacactcctcaaaatatacttttcagtggtctcggacgcaatctctacccacaatcttttgtattatatcatatccttacatctcttgcaagattctatataactaactttaaaatgtggcaaaacacggttattggtcactcccatgtcaatcactatgctgattggcatggatgatgcatgttgtaccggttcggctcattgtttgcgtaaacaaacagggagcgaagacatccagctgatgcctttcgctccctgtaaaatacgtcttactttcttaaacctaatctttcgatcagtgaacgatatctttcaatgtcattcttcttaaggtatgcaagaagtcctcttctctgtccaaccatcttaagaagtcctcttcttgagtggtgatccttcggattagctttgaagtgatctgtaagatcattgattcttgctgtaagaagagctacctgtacttccggagatcctgtatctccttctgttcttccgtattctttgataatctgttctttcatttcttttgtgatcatttgtcactacctcctaaatatactgttaattgcctgatattaagcagtggttggagattccatctgccgaacatcggtttttcatacttgcctagtgtaccatatgccccgaatcctgtcaagaaggattttatctttcccgcatctgacaggttttcatattcctgttcacaggctgcctgtaaataaccgcatttccggagctttttcaccggctctgttatttcttatgatgataacggaaaaattcttttgcgtaagcaatatcctgatcgatctgagccttcatcatttctatcgattcaaacttctgctccggtctcttaaaatgataaagctggatctctacctcttttccgtaggcatcaccactgtaatccagcagattgctctcgatcagcatccgcttctcatcggataccgttggcttaaacccgacattaccgattccgttgtaccagattccatcaatcctcacactatccagataaactccgttcggtggaagaagtttatcccttgacggatgtacattaagtgtcggaaatcccagttttctgcccagctgcctgccatgctctacttttccccgtacagtatatgcataccccagcatatcattcacagcttccatatttccctttcgaagctcttcccggacatagctgctgctgatctcccgttttccgtacatctctttttcaatcacaaaaagttcatatccatacacatcggcatattctgcaagcatttttgcatcaccacgcttgtcatgcccaaagtggaaatccgttccgatcacaatataccgggcatgaattttttcaatcaggatcttcctgatgaaatcctctgccgacatacttgtgacatcttcggaaaacgggcattccagcagtacatctactttcccgtccagaagacatctgcgctcctcattggacatgatcccttctcttgattttccaagcttttcataaagcggattcatatcaaatgcaaacacaacagaacgaacgccttttttcgccttcagctgacatacttttttgatcagcttctgatgtcctctgtgaactccatcaaatttgccaagtgtgattgctgcctctctggaatcctgataggcttccagacctctgatatagtccatgttctttcctctttaattactttttttcatttccatcaaaaaacatttttacaatcttgaagagatcgtctttcctgcagtaacagtaaatcgcaataaactgatgcgattcatcgtacacgcggactctctcatcgttctcatactcctttaatgctgtttcctgtgaaatatctctttttctgaaactattcccgttccgtactgccgcggccgttttcggtggcagtacgacctgtgcatacgttggaaacatttcatctatcgcgatgatcttctcctccagaattccttctttctgaagctgtgcaatttcaccgagccggatactgtcttcaagtccaaaccgctctacacgtgttctcaaaagctctttcatgcatccgccacagccaagcttctgaccgatatcatgacacagtgtacggatatacgttccctttgaacaggtcacttccagttttacctccggaagattgatctccaggatccggatctcatgaatcgtgattcttcgtgctttccgctctacttcttggccctctctggcaagctcataaagctttttcccgttaactttgagtgccgaatacatcggcggaatctgatcgtattctccctcaaagctgcggatcacattttccactttttcattggtcagatcttctgtgctatgtttttccagaacctgaccggaagtatcctgtgtatccgtcacctgaccgagaagaagaaccgcctgataggttttatctttatctgtcagcaggtcacaaagctttgttgctttcccaaagcagaccggaagtactccttcggcatccggatcaagggttccggtatgcccgatctttttctgctttacgatcccgcgcagctttgcgaccacatcatgggacgtatagcctttttctttatatacattcagtacgccatgtatcattccgcttcgctcccactgttaaactgaagttccagtcttcttgccagattgttgatgatatcatgtggtgtggcagtcatggagaatccggctgcccttgcgtgtccgccgccgccaaaatagcttgcaactacacttacatctatcttttcactggatcgcagacttaccttaaaagttccatgttcaagctcatacataaaaattgcaacatcgataccttttgtgagtttcagctggcttacgattccatccagatgtttcgcttttacctggtagaaatccatctcttcttttgtaacgtaagatacaatacatcttccgtccataaaaagaaagctttccaacaatgcacgccccagaacctggttctgtgcataggtcttttcatcaaaagtctctgtaattatttttgtaaaatcgatccctttttccatcagtgctgctgctgcgcgcatggtcgacggatgggtacaggaataacggaacacaccggtatcatgcaccattcctgtgtaaaggcactcggcagtctccacagacattttcccataatccagcagatcgtagatcagctcacttgtcgagcttgcatctggcatgatatagttctggtctgcaaaactctggttgctcacatgatgatctacacagaatcttactgccgcttttttgaaaaggactgccgaaaatccaagtcttcccatatccccgcaatccagtgcgataaacaaatcataggttttttcttccgtcacttcatgccggatcttatctgtatttttcatgaacttcagtgtattcggaagctcttccagataaacatcgatctctttttcaggaaaattctctctgacatagttatacaatcccatgcaggaaccagcacagtccccatccgggcggacatgtccgccaagtgcgatcgtcccggcttttgaaattgcatctaataacatactaatcatcctcttcccgtaaatctcttgttacatcatcaattttctttgacatccggacaccatattcaatggactgatccagtacgaacttgatctccggtgtgttacgcatattcagtgtatgagcaagttcgcggcggatatagccttctgcgctctgtaatcccttcagggtatcagtctgggctttttcatcgcccaggacactgatatatgctttgcaggttttaagatccggagcaacctctaccgctacaaccgaagtcatcggtgcaacacgcggatccttgattcctccacgcagaatagtactcagttcacgctgtacctctgcgtttactcttgtattcttaatgctgttttttctcattttctacccttctttatctaggaacttccaccatcttgaatgcttctacctggtctccttctttgacatcgttgaaacgttcaaatacgaaaccacattcatatccggctttaacttccttcacatcatctttgaaacgctttaatgaagcaagctttccatcatagatcacaacgccgtcacgaacgattcttgcctggcagtcacgttcaaatgtaccgtcaaggacataagatcctgcaattgttccgactccggaagccttgaatgtctgacgtacttcggcatggccaagtaccttttcttcaaatacaggctcaagcatacccttcatggctgcttcaacgtcttcgatcgcattgtagatgacacggtacagtctcacatcaacgccttcacgttctgccgtttcctttgcagttgcgtccggacgtacattgaatccgataatgatcgcattggatgctgctgcaagcgtaacgtcagattcattgatcgcaccaacaccaccatggatgatcttgacaacgacttcttcattggaaagtttgacaaggctctgcttgatcgcttctacagatccctgtacgtctgcttttacaacgattccaagttcttttaagttgccttcctggatctggttgaacagatcatccagagacatcttggacttggtttcttccagtttcttgatcttgttctgactgatgaatgtctctgcaaagcttcttgcatctttatcattcttgcagccaacaaatacttcacctgcattcggcacatcattaagaccgaggatctcaaccggcatagaaggacctgcttcttttacacggcgcccctggtcatccatcatggcacgtactttaccatatgcagaacctgctgcgatcggatctccgacacggagtgtacccttctgtacaagaacggttgcaaccggtccttttcctttgtcaagctcagcctcaattacaagacctcttgcgcggcggttcggatttgctttcagttccatcacttctgcggtaagaagaaccatttccagaagctctttgattccttctcctgtatgagcagataccggtacacagatggtgcttccgccccagtcttccggaatcagttcatattcggtcagttcctgttttacacggtcgatattggcacttggtttgtcaatcttgttgatcgcaactacgatctcgatccctgctgcctttgcatggttgatcgcttctacagtctgcggcatgacaccgtcatctgctgcaacaaccaggattgcaatatcggtagaatttgcaccacgcatacgcattgcggtaaatgcttcatgtcccggtgtatcgaggaaggtgattttctcaccgttgatttccacaactgaagcaccgatatgctgtgtgattccacctgcttctcctgcgatgacatgggtatcacgaatcttgtcaagaagagaggttttaccgtggtcaacgtgtcccataacgcagactaccggcggacgtttcttcattttcttttcgtcttcttcgtcttctttcagaagttcttcgatcacatcgactacttcttctttttcacagagcacatcgaattccagagcgatttcttcagctgtctcgtaatcaatttcctggttgactgttacaatcttgccctgcatgaagagtttcttaacgattacggatggctggatcttcattgcatctgcaagttcctggattgtaagtacttccggaattgtgatctgcttgatctgctcctccacaacctctttcttcggctgtggttttaccattttcggctgagcgttattgtttttgccctttttgcctttctgcagtctgtcttcgttctcttcatttctgttatattctttcttcttgtgcgcatcttttggtttgttgcggcttggtttctgttctgcgattgcaggtgccggaatagacgggctggattttcttctgtcgtcacggcgtccgccatcacgcatctctcttccgtctctgttatcacggttatctcgattatctcttctgtctccgcggttctggaatccgccatctcttcttccatcacccgggcgtccctgtctctgatcctgaccgtttcttggtccgtttggatttctgcgctgtctgttatcacggttttctccctgcggacgatcctgtctgtttccgttctgcggacgtccctggccatttccattaccctgcgggcgttcctgtctgtttccgttctgcggacgtccctggccatttccctgagagcgtccctggctgttaccattctgaggacgttcctgtctgtttccattgccctgtgggcgtccctgaccatttccattgccttgcgggcgctgtccgtttcgactgccctgcgggcgtccctgaccattacggcctcttccgccgccctgtgagttctgcggtctgaaaacctgaacgatatttttcttcttcggggtatcttcagaagttttttcactttttactgcatcaatctgttcatctgaaagtgtactcatatgacttgccacctcaattcctttatcttttaatatagagagtatttctttgtttgtcttattcatctgttctgccagttcatatactcttaattttgccataaatctacctcctgtatacagttcctattatccttcttccatatccagatgttttctgattccttttgcaaaccctgcatctgttactgcaagcgaagcgcggaactcttttcccatcgcatggcccagggtatctttatcttcaaaaaagtatattggcactttataaaaatcacacatgttctgaaatttcttttttgtattgtccgatgcgtcgtctgccacaatcaccagatgcgcgcgtccttccttgacttctttttctgtcatgaattccccgctctttgtcttgccggctttggtcgccagactgatcatcgataatgctctatttatgttcaagctgctccagctccttttccagattttcgtatatctcttttggtatcgcctgtttgaaagaacgttccagtcctttattctttattgcttcctgcaaacattttccggaagagcacagatatgccccgcgcccgttcttacgtccggttgcgtccagaatgaattcgccttctgctgttttcagaacacgcagcatttcttttttattcttcatttcctgacatcccacacatttacgcatcgggatctttttggtcgtactcaaataatcacctctgtctattcttcatacagatcaagatcatctgctacttcttcctctgattcttcatcagcagaatattcttcgtctgaatactcttcctcctgataatcatcttcataattctcagccatattcatataatctgccggaagttcgccagactcgatcgcctgtgtttcgttcttgatatcgatcttatatccggtcagtcttgctgcaaggcgtgcattctgaccttctttaccgattgcaagtgaaagctggtaatccggtacaattacacttgctgttctctcatccggatcagccattacagaaataaccttcgccgggctgagtgcattctcgatcaggattgccgggttatcactccagttgatgatatcaatcttttcaccgcggagttcatttacaacggctccgactctggcaccgttcataccaacgcatgctccaaccggatctacatccgggtcgttagaccatactgcgatcttggtacgggaacctgcttctcttgcgatgctcttgatctctacaataccatcacgcacctcggttacttccgcctcaaaaagacgcttaaccagttccggatgtgttcttgatacaaggatctttggtccttttgtcgtgttcttcacctctacaacgtaaagtttgatacgctctgtcggctcgaatttctcaccttttacctgctcattctcagtaaggatcgcatctgcttttccaaggtttacactgacattcttgccaatatatctctgaaccacacctgtcacgatatctttttctttttcaaagtactgatcatatacaacttttctttcttcttcgcggatcttctgaagaatcaggttctttgcattctgtgttgcgatacgtccgaaagatttggactcaaccgggatctgtacgatgtcaccgatctcataagaaggatcgatcatcttcgcatctgcaagactgatctgttctactttgtcctctacttcttctacaacggtcttctcctggatcagagtgtaatcgcatgtctccttatccataattactttgatattgtctgcttttccgaaatgattcttacatgcattgatcagtgaattctcaatggcatccatcagagtatctctgctgatatctttttcctcttcaagaattgtaagtgcttctaataattcggtattcatttccttcttcctcctgtcactagaaatcgaacgccagacggatcagtgcgatgtctgctttatcaaatgtcatcgtctcgccgtcttcatattcaatggtaactgtatctttatcataatcttttaagattccaataaactctttctgtctgtcgattgcccggtaagtacgaacctctacttcttctcccaggcttcttgcaaagtctttttctttcttcagcggtctgccaagtcccggcgaactcacttccagaatatacgcttcatcgataaaatccttctcatccagaatgtctgaaagttcccggcttacaacctcacagtcatcgaccataattcctcccggcttatcaatataagcacgcaggtaccagtttccgccctcttttacatattctacatcccagagatcaaatccatgcttttccacgattgggttcagaatctcttctgttttctgttcatatacttctttttttgacaatctgcaacttcctttcttaatcaggctccaaaaatctgtccgattttggttgtatgactggcaaaaagaagagtgaactttcgtccactcttctgccagatttcttatgtaactgcatacagtatagcactacttttcctgaaatgcaaggatttttaaaatatatgcctgattctctttgtatagacgctttccgtcgttctccttcagccattttacaacctggatatctgctgcccagtcatctgcccagacttcatcaccttcgccacgcgccgccgctttttctgcgatgtatcccgccgggtcttccgtaagatctttcagtacttcatatgctttttccttcttatcatccagatcctgtatcaaaacaacggtttctgtatccggtgtctttccatcgagcgcctgcagctgttcattatatttttccagattctccaggctgtccttcgcatcctccagacattctgtcaggatttcgatctccgtttttccagtaccaccctttgcaaccgggcggatagatatttctgaatcagcagtcgtctttttcagctctgcccgaatcctctcctcatcgtgatccattcttccgatatcatatccaaagtaaaaaccgccaattccaatcacaacaagaagaacgattgcaaaaattctttttccggattttttctttttcatcttccgtcctccttaccctaatatcgtacctgctataattccaaggatcattccgccgatcccggttcccgcaagcgccgcaagatataagagtaccttcaccgctttggatttctcctttttcacctttggaagtaccggaccaggctccggtgttcgcctctcctgcgtctgttccggtgtctcctgccgcggcattctttcgatttcttcttgtgtcggataggcaaacggcatcacatctgcttcaagagctgaaaataattttccatcgatccactgaaaatactgcaagatcgccgcatcaaacatccggtgggtatccagaaaatgataccaggattccacaaaggtttttgtttggaaatattctctatacgccggttcctccagaatatccttccagtgatacagcttattccgttccttttcattcaaatacagactgatgcactgctccatgattttccggacctcacggtcatccgcgccttgtcgctcagaagcatccgccatattctggaactgacgggtccagtcaccgtcccacgcttctgagtcgtccttcggttgctcaggaggttctactgactgtgtagcactctcctctgacttttcatctttctcccgagaattttccatgcgatcttctccggattcttcttccatccgccgcggctcttccggcaagtgctgccgccgacggtgttaaatattctcccagattattcggaatcaacgtgcatttatcatcctgccacacgcttaccagactgtttgttgttccaagatcaattcctaccgttgccatacgatcgacctactttctcattcgtgttcctgttccatctcttttcgcccgtttcaagcggttcagtgtcacttctttttcatggaagatcaccttgctctccgttccttcttcaaacagatatacctcttccacgctgtcatttttctgtaatttcataccgcgtacaccaactgcaccctttttcttctccgaaacttcttccgccgggaaacggagcacaaatccattctccgtcatcagaactacatcctgcacatcccggatcggccggatacttaccagtgcatcttcatcctgcagtttcgttgccgcgattgtccgcttagttacctggaattcacttcctgccacctttttgatcattccctgcttcgtgacaaacaggaattttgagaaaaagagttctctgtcatcacacagatatacgatttcttcttttgtactgtcaaaattacttacattgtcgattggaaatcctttgtccctgaattttccataagggagatccatcactttgatctgatgcatcttgccatccgatgtaaaaagacacaacttgccggtattcatacagcgcagaatatacttattctctttatctgccgcttcccggttacgttcatagacggatccatccaccgtctttgcataaccaaagcggtccatcagaaggacaacctcctgctcctgtactttattttcctcaaacacagcttcttctgcattctcgatcttcgttttacgcttcacggcatattcttttttcagcgcatccagatcatcaatgatcacctgcgccatagaatcataattattcagaatatcctcatattttgcaatatttgcaagcgttgtctcatgctccttcatcagcgcctcgatttccagaccgatcagcttgtacagacgcatctccagaattgcctgtgcctgccggtcggtaaaccggagcatggatgccatcttctcagatcttttcgccttaaacttgatcttctctgtcgcacctgttgtcagacattcttttgcatccctgatggacgagcttccacgcaggatctcaatgatcaggtcgatcacgtcacacgccttgatcagaccctcctggatttcttttttatcctgctcttttttcagcagcgtcttgtattttctggttgcaagttcaaactggaaatctacatgatgttcgatgatacgtttgagtcccagtacttccggtctgccatcggctaccgcaagcatattgacaccaaaggtatcctccagtctggtctttttataaagcatgttgatcagattgtccacatctgcatcacgcttcacttcaattacaatacggattccttccttggaagactgattggaaatgtctacgatgtcactggtcttctttgtctccaccagattgcagacatcgttcagaaatttaccgattccggctccgatcatggtgtacgggatttcggaaatgacgatcttcttccgtccgccttttatctcttccacatctacttttccacgaatcttgatctttccggttccagtctcataaatttctgccagatcatctttattgacgacaataccgcctgtcgggaaatccggtcctttgatgtacttcatcagctgttttgtcgtgatgtcattgttcttcatgtatgccttaaccgcatccacaatctcgcccaggttatgtgtcggaatactggttgccataccaactgcgattccttccgcaccgttcagcagaaggttcggaattcttaccggaagaactgccggctctttttctgtctcatcaaaattcggtacaaaatcaatgatatctttgtccagatcggcaagatatgcctcctgtgtgattttcgccagtcttgcttcagtataacgcatggctgcagccccgtctccttcaatggagccgaagtttccatgaccatctaccaggatcattccttttttgaattcctgtgccataacaaccaacgcttcatagatcgagctgtctccatgtggatgatatttacccatggtatccccgacaatacgcgcacatttacgatatggtctgtcataacggattcccagctcatacatgtcatagagtgttcttctctgtaccggtttcaaaccatccctgacatccgggagggctctggaaatgataacactcatggcatagtcaatatatgattttttcatcagctccgaatattccgtccggatgatctgtgactcttccattttctcttacctcttctagtttatgttttctgatgcacagactttccccttttgaaaatccatgcctttccgatctgtttttaaatatccagttctgcctctgtcgcattttcataaataaatgcgcggcgcggcggaacttctgttcccatcagcatctctgttacaccggatgccatacgtgcatcctcgatctcgatccgtttcatcattcgagtttccgggttgagggttgtctcccagagctgctctgcatccatttcacccagacctttgtatcgctgcagggtaaagtcggaatgtgtctttctatatctctccagtgccttatcatcgtaaaggtactcttcttctccctttttcggcattgccttataaagcggcggcattgccacgtagacatgaccttcgtatatcagttccggcataaaccggtagaataaggtcagcaacagtgtggaaatatgcgctccatccacatccgcatccgccatgatgataatcttgtcataccgcagctttgtgatatcaaagtcattaccgtatccctctgaaaatccacatccgaatgcattgatcatggtcttgatctcggcatttgccagaaccttatcgatgcttgctttttccacgttcaggatttttccacggatcggcaggattgcctgatacattctgtcacgggcagtctttgcgcttcctcctgcagaatctccctcaacgatgaagatttcacatttggatgcatccctgctctcacagttggcaagcttaccgttactgtcaaaagaatatttctgcctggtcagaagattcgtctttgccttttcctcggtcttacggatctttgctgctttttccgcacaggaaagaacctttttcagtgtctccagattccggtcaaagaaacgcgggatctcatcactggtcacctttccggtcgcttttgccgcatcctggttgtccagctttgtcttggtctgtccctcaaatctcggatccgggtgcttgatcgatacgatcgccgtcattccgttccgtacatccgcaccggtaaagttggcatccttatcctttaacacaccaatttcacgggcatactggttcatgatcgtcgtaaatgtcgtcttgaacccggtcagatgggttcccccttccgcattataaatattgttgcagaaacctaatacattttcatgaaattcattcacatactggaatgcaacttccacttcgataccttctgcttctcctttatagtaaaccggatcgtggatcacttcttttttggaattcagatccttgataaatccaatgatcccatccggttcatgatactcgatcctctcttcctgtgtctttcttttatctgtaaatataatcgtcagttccggattcaggtaggctgtctcatgcagtcggctcttgatctcttcctctttaaatctcgtcttctcgaaaattgtcggatccggaagaaaattgacacaggttccggtctttttggtctttccgatcaccggaagaagcccatcctccagttctaccaccggaattcctctctcataacggtcgtggtgaaccgcaccgtcacggctgatctttacatccatataagtagatagtgcattaacaaccgaagaacctactccgtgcagaccgccacttgtcttgtatgccgaatcatcgaacttacctcccgcatgtagggtggtatatacgattctggccgccgatactccttttgcatgcatacctaccggcacaccgcgtccattatctgttaccgttgcagaaccgtccttttccagtgtcacctctatctgtgaacaaaatcctgccagatgctcatctaccgcattatctacaatttcgtacaccaggtggttaagccccttggtactgacgcttccaatatacattcccggtcttttccggacggcttccagtccttccagaatggtaatactctccgcatcatatgtagtcttttttgccattttctttctctcctcttatgatctatcctaaaatatccaggtaaaatcctgcggcagcagcctccttacaatttcccggattccctgatctgtttcttcaattcagtaagaaaaattctatctcaatttcaatcctcttgtcaagccaaattgacctcccccgccattataacatattttatatcgttaaacttctgtagtttccattctgtcataagaatactccctctatcgtccggtcagcacactatttaaaaggtctgccagcacctccatggcatttcgcatttcctctaccgtgttggtctgcgcgcccgcctcaataagaagcatccgcggcatcagatccatattgtatttatagccgcgaagatagtttcttcttgcaaatcccggatattttgtttctgccgcaatcttcatctgcagggaaaatgcaagattatcctgcaaatatggattggccattccgacaaggtctccgtttacccgcgtccgactcagtccgttaaaaaacatgatctgtgccgtcggtttcccatttatctctgtcaccagatgcgtagtatccgccacgccgtctctatgcaaatcgatcaccacttcgatactcggattttccgcaaggatctgttccacctcaggtttggcaaattcataggcttcgctccggtccagtttcccattgatcagatcatatacaccctcatgatgcatggtcggaatcttgtatttgttatttaaaatctccgtcagataacgcccgatccctacaattgaggtggacggatcattgtccgaatctgcaaatgtctcctgggaatgggtgtgatagatcaggattttcgaaccgcccgtactcagatcgatcctcaaatcctttccaagcagctccgaagcgttcaactccgaaggattgatataagtcacgctgtccaccgtataaaaattgctcacaagatattcaaaatcatttagccgctccatcgaaagatccatcgtcggtacggacgcctgccttgtctcttcacttttgtcttttccgataagctgtccattttcatccaccgaattttcttcttctgcctgcttttttgcaagaatcgcataggtagcctcatcttctgtcagaagctctgccgcctcccgttcagtcacataattgccaagaggaatcagggcagatgccatgtggacaacagcctccgtcacccggattttcccttgttttttttccgtatatgtaactcccggcatataaagccgctccgcattctcctgaacgctctggatcatcctgatcttccaggacttcgggatcagcgaaccgctgctttttgcttccagtccccagattcccaaaatcataatggcaagaagcacacaaattctctgttcttttttcatctgcgcgcctccctgccagtttctgaagatcgctgtggcaaaaccatatctttccagactggatcctgcccctgaccttttgtgtcatattgacataatatatgcagctcactgcctgattatgtcgctgaagctgcaaaaagcatattcagtgcctccgaaatcgtataactgattcgcctgacggtctcatcaatatcttttggtgttacaaacattccatttaaatgtggcgcgatcagttctttgatcagctcatatttttctgccggactgtatcctttgatcacacttgccatgccttttaaagattcagatacttccactgcactgagcagattatccatcgtatcgcctacaatggttgccgcatccactacagtcggcacaccgattgcaatcaccgggatcccgactgtcttttccgtgattgcatttcggtgatttcccaccccggatcccggattgattcccgtatccgcaatctggatcgttcggttcagcctttttgaatttctcgctgccaacgcatcgatcactagaaggatatccggttttgtctctgccaccaccccccggatcacctccacagtctccattccggtctgccccataacccccggcacgatcgcgctgaccgaccagacctcatcttcccctgttgcatactttccgtactcctcaatgatatgccttgtgatatgcaggttgtctaccacataaggaccaagtgcatccggtgtcacctggcggttgccaagaccgaccaccaggatcttttccatctttcttttaggaagcagttctccaatgaatttccggagctgctgtgaaatctcctcatgatatccttcatcgggaactgccatttccggtgcctcgatcgtgatatagctgccaaccggtttccccatcacttttgctccgttttcggtctcaatcctcacggtcgtgatgcggatctcattttcctcatcatactcttccgtcaagatcacaccctgaacctcaacatggtcagattcaaaccgttccttctcttccagcgccagatccgtcctgatattatacttttcaaccatagttctctcccatttctgtattttctgtcttattcacttagtttttcgcaaaaaattggaattatgtattgacaagcaatctttcttcgcctaaaataaataagtgtgttcgacggatgttccgtgtcacttttcgtcgaattcaatattatgattatataatttatgaaatgataatttggaggtgtcggaaatggctaatattaaatccgcaaaaaagagaattttagtaactgagacaaagacagctagaaataaagcaatcaaatctaaagtgaaaacttatgtaaagaaagttgaaactgctgttgaaaagaaagacgttgaaactgcaaaggttgcattaaaagaagcaatctctgtaatcaacaaagcaggaagcaagggtgtttaccacaaaaatacttgcgcaagaaagatctctcgtttaacaaaagctgttaacgaaattgcttaattccggtttcgagataaataatgaatgataaaaaggcagccatcccgtcagtggctgtcttttttgtgagttataggacaaaatgtgttgatagaaaccgccttcagcccttgaaaataaagggttgaaggcggtttaatctttagatgcaggaaaagcacagggtgagtatctgtgtgaagcattcccggatggagcttcaatcttgtattttaccggtgcaccaaatgatcagcagtatgtcgatcgtaaaaaaggactggaagaagcacttaagaaaaatccaaatatcaaaatccttgatgaatataacgtagaaaattcaaaagaccttggtatgagtactgcagaagacagtcttctttcttatgacaagattgatgcaattgtatgccaaaacgatgatggagcacttggtgttgtagaggcgcttaaatcagcaggaaaacttgacagtattcaggtacttggaattgacggaagtgatgatgctctgcagtcaattcaggatggagaaatgacaatgactgcacttcaggatgcaaaggcacaggcagaagcaggagcagatatttttgaaaaactgaaaaaaggaacagatccggcagatatcgaagatgtcaatattccatttaaaattgtaacaaaagataatgtagcagattatttaagtaaataataaagaatgaaattctccccttgttagatgtgatggcacaaaaggcaaggggagtgctgtaaaggggactactatggaaaaatacaggaataaagatcttcccgtagaagagagagtggaggatctgctggacagaatgacttttgaagagaaaattgaccagattacatgtctggtaactattgctgatgatattccggagtttgaaaattatataccgaatggcattggaaatgtaggtgcatttacagtagcagatacggtagagccaattgtggaatatgcggataagttgcagaaatatctggtaaatcatacacgtcttggaataccggcactgattcactgtgaggcgagtgctggggcacagtttacggaggcggatgtatttccgagtgcaatagcgcaggcgtcaacgtttgatacggaagtggttggcgaaatgacagatattattcgcaaacaaatgtattatgttgggttcagacaggcactttcaccggtagtagatattacaagagatccgagatggggacgtattactgagacatatggggaagatgcagcacttacatcagccatggcatctgcctttgtaaaaggaattcagggagatgagctgaaagaaggggttttggcgactgcaaaacattttgcaggtcacggtatcacagagggcggtcttaatatggggcgtaatattgtttcagaaagagatatgcgggagatacactgtaagccgtttcaatgcgcgatcacggaagcaggactgaaaagtgtaatgaattcctattgctcagtgaatggagaaccggttgtaggatcaaagaagatgttgacagatattctgcgtggagaaatgggatttcagggttttgtggtttctgattatttgtcacttgaccgcctggtggatccgtttgctgtcgctgagaattttgaagaggccggaattcgtgcaatccaggctggattagatgtagagtatccaagatcaaaaggattcagctataaaatgaaagagtcgattgaaagcggcagactctctatggatataatagatcaggcagtacggcgtgttttgacacagaaatttgaacttggtttatttgagaatccttatccggatcttgaaaagctgaaaaaatatcttcatcttaaatcaacagatgaactgaatgaaaaaattgcagcagaaagttttacactgcttaaaaatgaaaataaaacacttccactttctaagaaaattaagaaaatcgcggtaatagggcctcatgcggataatattcgaagtctttttggtacattttcttatccggctgtacttgatatgaccatgtcgagagaagaagatgggcaggaatttgaagagccaggactgattatttatgatgttgaacagaaatataaaggtgagattcgagaagtatcaccacgggtaaatcgtaagattcaaaaggaatttccaaactcgagaacattatgtgcagcattgaaggaatatcttccagaagcggaagtggtttatgcacagggaattaactgctctggagacaatacaggtggcatggaagaagcactacaggtggcagcaggggcagatgtgattcttttgactattggtggaaaaaatggatggggcgtaacttcaacggttggagaaggtatagattctacggatattgatctgccgggacgacaggaagaatttgcaagaagggtttatgatctgcataaaaagacagtggttcttcattatgatggcagaccgctttcaaatgaatttgtggcatcacattttgatgcgattatggaagtatggcagccgggagaatatggcagtcaggcactgtgcaaggtattgtttggtgaacagtcaccatcaggacaccttccggttacagtagcaagaaatgtaggacagcttccagtatactatggtcttccaagaggaagcggatatgtatcagccggacatacagggatgattcgcaataaaaatggttatatcaatgatacggcagaaccgctgtattattttggacacggtctaagttatacagaatttacctattcagatttgcagacggataagaaaaacataaatccggatgatacagtgaaagttacttttacagtgaaaaacacaggagaatatgatggcgcggaagtcgtacaattatatttttcagacaaggttgcatcaatggtaagaccaacaaaggaactggcaggctttgtaagaatattcctgaaaaaaggggaaaagaagaaagttgtatttgaaataaaggtgtcacaattcgccttccttgacgaagaaatgaagtggaaagtagaaaaaggtgaaattgaacttctggcaggatcttcttgtgaagatattcgactttctgatatagtcagcatttcagaagatgattatattgatggaaaaacacggggattttacgcaaaagcagttgtttgttaagaaaggctgtgagtatgaaatttacagaaggatactgggaaaaaaatgaaagagccaatgctttgtatgctgtgcaggccggttatgcagaaaaaatagcggctagtatgcgtgtgattgcaacgtttaaaccaatcctgggaagagcggatgaactggatgtcggtacaatggtaatggaatttactgcagccggaaaagatcggattcaggtgacatacacacattttctagggtatgaaaacagagagccacgatttgaactttttctggaacatcaggaagcggaagttataatttctgaggaggaagctgtattaaaaagtggaaaaatgacggttcgggtaggactgaaagaattttatatccgatttgagagaaacgggaaacttcttaccggtgcagcttttaaaaatgtcggttatatgcgctacaacagagggtatgcaacaaaatatccagaagaagagtatatggcagaaaccggggaaccgtatatgttaaatgagttgcttctaacagcaggaacgaacgtatatggattgggagaacgttttacagcatttgttaagaacggacagcagattgactgctggaatgaagatggaggaacagcttcgcagatcagctataaaaatattccattttatatcaccaacagaggttatggcgtttttgttgatcatacttccaatgtttcatttgaagttgccagtgagaaagtagaatatatagggttttcggtaaaaggagaagaacttcgctattatgtaatcggcggggatgatatgaaagaaattattcggaattatacggatatgacaggaaaaccggcacttcttccagcgtggtctttcggtttgtggctgagtacttcatttacaacagactatgatgaaaagacagcaacagagtttattgaaggaatggaaaaaagagatcttccgctggaagtgtttcattttgactgtttctggatgaaagcattacattggtgcgattttgaatggaacaataaaatttttccggaaccggcagaaatgctgaaacgttataaagaaagaggactgaaaatctgtgtatggatcaatccgtatattgctcagaattctacactatttgcagagggaaaagaaaaaggatattttcttttaagaaaagatgggttcggaatcaagcaggtagacaactggcagccgggaatggcaatcgtggattttacgaatccggaagctgtaaaatggtatcaaagtaaattaaaaatattacttgatatgggagtagactgctttaaaacagattttggagaacgaattccgatagacgtagagtatcatgatgaaagcaatccatggggaatgcataattattatacatttttgtataatcgggcagtatttgagcttttaaaaagagaacgtggcgagaaagatgcagttgtgtttgcgagaagtgcgacagcaggcggacagcaattcccggttcactggggtggtgactgcacaggtacatttgagtcaatggcagaatctttaagaggaggcctttctcttactctttcgggattttcttattggagtcacgatattgggggatttgaagaagctgccaatcctacggtatataaaagatggctgcagtttggaattttatctactcacagcagactgcatggttccaagagttaccgggttccgtggacgttcgatgaagaggcagttgaggtgtgtcggaagtttacaaaattaaaacttcgtctgatgccgtatatctacgaagcggctgtacggtcaaataaacttggaatacctgttatgagaccaatgatcatggaatttgaaaaagaccctgcagtgcgatatctggatcaacagtatatgcttggggagcagattctggttgcaccgattttcaatgaagagggtattggtgagtattaccttccgaagggaagatggacacatttgctcagcggagaagaaaaagaaggtggacgctggtatacagaagtgtatggatttgattctctgccgttgtttgtccgtgagaacacgcttcttccaattggtaataatgaaaaaacggcaacatatcattacccggagcagttacagattctggtatatccactagaagaagacaagattgcggaatgtattgttccagatgaaaaaggaaatgaggttctggatattactgccagatataaggatgaaaaaattgttctgtgcagttcaggggaaaatgaagaaattacatatcttttggtaaatgttcatgatgtaaaagaggtttgcggagcagaatggaaaaacacagaacgcggaacagtgatatatccgaaatgtgatattgttgaaattgtttttagaaaataaagagcaacatgaaaaggcagagattttaacagaatgaaatctctgccttttttgatagaaaataatattcatgttttcttcaaaatcgcatataatgtaatgataataaagcggaaggatagttgtaaaaagatggaacagtatacgttccagatttatttggttatattagcgatattggtcatgagccttatgattgaaagaaatgacctgattgaaagccagaagaaaagagaatttttgcatttctggtaggtggacatgcactgattgaaattttatccgtatatttcggatagatttattatattgatgcgcagagcaattatcatcatgaaagattttattgggcatatattgccttttatctcggctgtagtttatattttgttgttcaggcatggaagttcggagggagatatcagaacagtaatcgtattgtattgggaacaatactcttttcttaatctctggtgttatgtttgggatgataagcagtaaggtacggacggattatatttgcctggcgatggttatatttattatagcagtattatcgtgaagacagatgtaataacaggacttatgaacagacagagctatgagggaaggattccgtatgtatctgtcggctacagcagatttgatccggataagaatgattgtgaaagctgtgtaaaagaagcggatttacagatgtatgagtggaagcagaggagtaaagaggagcgaaaaaacagttgatttttatttcatgttaaaaataagaaaaaagttgataaaaaaataattttataaacagaaaggtttgaattttgtagactaaggtattataatagcgtaggaagttgaaaacttcttaatcaaattcaaacaaaaggcaggtgaacagaatggacagttgtgatagtcatgggcgaagtatatacgcaggatgggaaaatggcagcagttcattctgtttgttcgtatagcatttcttatcctgttttcccgtattgacattcataattgaatattggatgaaagacagaaatgtggagaattttagactttgattctgcatgtttttgtgctggaaaaggataaggagggcgaaagttatggaaaatacacaggattatcaggactaccaggactacagagctgagatcctgggcattgtaagaagcaatgcctctccgggaattatgagaaacaaactggaagactaccatgagaatgaccttgcagatgtattcccggatctctccgttgcagagcggcggaaattgtgccggattctgaatctggacatgcttgcggatatcttcgagtatatcgatgaaaagcaggctgctgaatatctggatgagatggatgtgcggaaagcagcagcaattctttccagaatggaaacagatgcggttgtagatgtactgcggatgattccaaaagaaaagagagctcttttgctagagctgatggatgatgaagccagaaaggatatggcagttattgctgcattcgatgatgaagagatcggttcaagaatgaccacgaattacattgagatcagagaaaatcttactgtaaagcaggcaatgaccgaacttgtcagtcaggcagcaaaaaatgacaatatttctacaatttttatggtgacagcggatcacaccttctacggtgcgatggatctgaaggatctgatcacggcaagacaggatacacgtcttgaggatctgatcgtgacatcatatccatatgtatacggtcacgagctgatcgatgactgtatcgaaaaattgaaagattattcggaaaattctattccgatcctagataacgataataaacttctcggtgttatcacatcccagagcattgtagatttggtcgatgatgagatgggtgaagattatgcgatgttcgctggtctgactgcagaagaagatttgaaagagccactcaaagagagcatgaaaaaacgtctcccttggctgcttgttctgctggcactgggaacagttgtatcttctgttgtaggtgtatttgagcaggtagtaagccagctgacgatcattatgtgtttccagtcactgatcctggacatggcaggtaacgtcggtacccagtcactggcggtaacgattcgtgttctgatggatgaatcactgacaggaaagcagaaagtagaactggtattcaaagagatgcggatcgcattttcaaatggtgcgattcttggaattttgtcattcctcgtattaggactttatattgcacttttcaaaggaaagacctggacattcgcgtatgcggtatccggctgtatcggtctgtctctgatggtggcaatggtaatttccggtgcggtgggtacactgattcctctgttcttcaagaagatcaatatcgacccggcggtagcatccggaccacttattacgaccatcaacgaccttgttgcggttgtagcttactatggactgtgtggtattctgttgatcggagtgcttcatctggcgggataattataaaagagagtaaaacgaagtgcgtgtaggatataaatgcttttactgaataaaacggtaaagacagtacagtatcccacatgcatttcttttatagaaaataaaaataaaaaaatagatagaaactataggaatgattatctatagagaaaaacaatttgaaaattaaaatatctggtgctagaatgtaaaaagcatgtcggaataatatcagagatatgttaaagggaggaacattatgaaaaaaatgaaaaaatttgcagctcttctccttgcagtatcaatggcagcaggtatggtagcctgtggaagctcagataaaaaggaagagactacaaaaaaagaagaaaccaagaaagacgacaaagagacaaagaaactggaaggaactctgaaggttgttacaacaggggatgcttatcagcctttatttgacaagtttacagaagaagtaggaccgaaggtagaattcatttccatgtcttcaggagaagttttatcaaagcttaaagcagaaggtggaacaccggcagctgatctgtggttcgggggcggaatcgatgcatttatggatgcaaaagataataaccttcttgaaaaggtagattttgatgcagcagatgatcttgcaccggaatataaggacagtgataattactggttctctaaaggtgttacagttgtaggatttattgttaacaatgatatcttaaaagagaaaggacttgaagctccaaagtcctgggatgatcttacaaaagaagaatatcagggtgaagttctgatgtctaacccggctatttcaggaacaaactacgcagtagtaaatgcacttcttcagacaaagggagaagaagaaggctggaaatactttgaagatctgaataagaatgtagattattactcaaaacgtggttctgatccgagcactaagactgcagccggtgaagttggaatcggtattacttatattgatggaactttagatgaactgaaagaacaggcagatgttgaagttgtatatccgacagatggaatgccatatgttccggaaggtgttgcagcatttgcaaatgcagaaaacacagaagcagcaaaagcatttatcaaatggttcttctcagatgatgaaaatatgaagatgcttgcagaaatcgatcataaaaatacttgtttattagtaaaaccaagtatagaaggacttgaactcgattttgaccagagcaaactgatgaaagaagatctttcactttttggagcagaaagaactacaattcttgataagtggaatactttgatgggagataaaggtgaagaatagaaaacctagagaaaaacgggcatcattttatgatgcccatttttataatatattggattattttatattagcagtgctggtagcaggtgtgttgatctttattctgtatccgcttctttgcatgatcagacagagttttgtgggagaagagggattttcgacagaagtttacaagagcatcttcagtgacaatctgcagcttgtaaaaaacagtgtttttgtaggtgttttatccgcattcttttcaacaattctggggctgtttgtatcaatctgtgtatggacagcagggaagaaactgggcaaatttctggaagcgattttgctgatcagcatggtttcgccgccgtttattgcttcgctcgcttatatccagcttttcggaagaaacggtctgatcacaaaaggagtgttcggactttcgctgaacccgtatggatggcttggtgttgttgtaatgcagacgttattcttttcttcattaaatgcactgatgattatcggaatgctgaggaaaatggatatgtcgctcgtaagggcatcttttgaccttggagcatcctccgggtatacattgtggagaattgttgtaccactgttaaaaccggtactactcagctgctttttgctttcgtttatccggtcgatcgctgattttggaacgcctgttgtgataggtggacgttttgaaacagtttcgacggaaatttatatgcaggtaatcggatattccagactggataagagtgcggcacttaatgtactgcttctgatcccgacgattcttgtttttatcctgtaccgctatctaatgcagaaaaatgaaaaagtcatcagcggaaacagtaataagacggtagaagcgggagatacattccgggttcgtgggctgtcagcagtgattgtatggctgggcgcaggtatcttttttgtaatgatggcgcttgaatacggatccatttttctaaacagtttcagtagaaacttacgtgggaaaatcacatttacaacgatgtatctggacgcacttctggaacggaatatggatacatttatccgaagtgtggaatatgcgcttattgtagcaatagtcggcagtctgatcggtattttactttcatattatattgaaagacgaaagataaaatttggcggagtactggactttattattacacttccgtatatgcttccgggaagttgttttggaatcggatatattctggcatttaatcatgaaccgttaaaacttaccggaacagcggtcattgttatcttgaatatgatctataaacagatgtcaattacaacgaaggcttcggcatcctcccttttgcagatcagtacagagcttgatgcagcagcgcgggatcttggagcgaataaatttctggtaatgaaagatgtcattcttccgaatgtaaagcaggcatttgcaacgggatttattaataattttacaagtgcgatggttacagcaggagcagttattttcctggtgacaccgggacagaagattgcagtatttacattatttgattgcattaacacaggtcggtatggagaagcatctatgattgcgacatttattattgtgattacaatttcagtaaatgtgctgttttcgataattgttgcatggaaagggaaaaagaaacgtgtatttagaactgaaaaacataagtaaaagttttggtgaaaaagaagtagtaaaagatttatcactctcccttccgaagggagaactgttgtgtcttctgggagcatccggctgtggaaaaacgacaacactcaaaatgataagtggatttttaaaaacagataaagggcaaatcctggttgatggccaggatatcaccacactggctccggagaagcgtccggtatcgactgtttttcagtcttatgcattatttccacatatgagtgttctggaaaatgtaatctatggtctgaagttccgtggcatccgaaaaaaagaagccagagaaatgggtatggaatatctgaaaatcgtagatatggaagaatatgccggggcatcgatcggggaaatttccggaggacagcagcagagagtagcactggtcagatctctgatcacaaaaccgaaggtgcttcttctggatgaaccgcttagtaatctggatgcgaaactccgggtaaaaatgagggaagaaatccgtgaaatccagaagaaatatgaaattacaatggtttttgtaacgcatgaccaggaagaggcaatggtacttggagatcagatcgctattatggatcagggaaagttggttcagattggaaagccggaagaagtgtatctgcatccacagaatgattttgcaagagatttccttggaatatccaaccgttttactgatatccatggaaatacaatatgctgcagaccggaggaactggaatttgcagcagaaggttctgtgaaaggaattgtaagacaggaagaatttcttgggttttacagacagtattatgttgaaacaatgaattatgaacatattattgtacggacagacagaaatataaaagtagaagctggcaaagaagtgcaacttcgggtgaaataaaaaagacactgtgcaaggtgacaatatctgtttgatatgctaccctgcatagtgccttttttattttgaggaatgaccggtcagacgtgcatcatccctgacatcacacaacctcctgcagcaccggcatttttcagttcgagcagttgtgcttcatcaattttgattccgccaatgccataaaccggaatctgcacagcttggcatacattctgcagaaatggaagtccccgtggcggaagccctttcttgcagtcggtaacataaatatgtcctgctgtgagataggaagttcctagcttttccgcttcgactgcttcagaaacagaatggatggaagttccaactgtatgaaaatcggaaaccactttcggattttcaagcaaaagtggaagtggtaaatgtagattgtcgcagccgagttctctcgcaacggctggataaaaatgcggaataaacggaactttaaactgttcacagatttccttcacctgccgggcaagagaaaaatattcctcttccggcagatctttttcacgtaggatcagagctttcggatgcagcttgcagacacgggtaatctgttctgtaaaaggacgggaacagagatggcggtttgttacggcaataagatctctatacatagatataatcactcataaccggctgcatattgttggaaagaagtgcctgataaacctcatctacggaacgtccgtcagaaatctcgaactggtcatctcccttatcctcaatatcatccacatggcttccgattccggtgctgactccggcagaaatcttggttgcagcaatctgtgtcagattgtctcttacacgagcacattctctggtagataccgtaatgcttgcaaatggcatgaacagacggtaagcacagactacctggagaagctgtggctcatggacatccatcggattgatccggtcattgttgatgatcgggcacagcctcggacaggagaacgcgatctcagcatgcgggtattttctctggagaagataagcatggtatccggttgcaaaagcatcttttctgaaatcatccaggccaagcagggcaccaaagccgacaccacgcattccgcccatcagtgcacgttcctgtgcatttacacgataagggaagatcctcttatgcccggcaagatgcagggtttcgtatttgtcggaattgtaagtttcctggaaaacggttacatagtctgcaccgcattcgtggagatatgcatactcatctgaattaaccggataaatttccagtccgataactttaaaatatttgcgcgcgatcttgcaggcatttccaatatattcgatggtagatttactgcggctttcaccggtcaggatcaggatttcctgaagccctgtactggaaattgcagccatctctttttcaatctcttcgtcatttaactgcgcacggttgatcttgttatggcagttgaaaccacagtaaatacaatagttttcgcagtagtttgcaatgtagatcggagtaaacatgtagacgctgtttccgaaatgttttcgtgtctctgcctgtgcagcctgtgcgatctcctcaagaagaggaagtgcggcaggtgagagaagtgcagcgaaatcctccggtgtacggatgtcatgcgcaatggcgcgtcttacgtcagcttcggtatatttttcataatcataagcgttcatggcacttatgacctgatccattacgtcagatccgatatcttccattcccggaaggtaagtcatatgatcaatgcggtttttcttctggtcttccagaatttcctcacttaaaatactttcgttgatatgtgaattttccattttgactgcctcctaattctctaagaatcctgtcagaggtgaggatgcgcttgcgcctctttcgatggtgcgtcccagtccggaaagataagcactgcgtccggcttcaatggcttttttgaaagcttctgccatggcaggaacatttcctgcagttgcgatagcagtatttgccatgacagcggaagcacccatttccatggcttcacaagcctgggaagggcgaccgattccggcatcaacgatgatcggcagatcgatctcatcaatcaggatctggatgaaatcctttgtgctgagtcctttattggaaccgattggggagccgagcggcataatgcaggcagctccggcatcggcaagtgctcttgcagcattcagatccgggtacatatacggcatgacaacaaagccttcttttgcaagaatttctgttgctttgatagtttcgtagttgtccggaagcaggtatttggaatcatgaacgacttcgatctttacaaagtcgccacatccgacttcgcgggaaagtctggcgatacggactgcttcctcagcattacgtgcaccggatgtatttgggagcagggttacattgtccggaatatagtccaggatatttgcaagaccgccttcatttgcacgacgcagggcaagtgtgatgatctgagcttctgctttttcgatacatgcttttacaagatccagagaaaatttaccggatccgaggataaaacgggaagtgaattcatgacctcccaggataaacttatcttcatttgtactcataataaagttccttctttcttatgtttttaaatttcttcttcaccgaggatcagccgcgtgatcatgttggcttcatgtgcggcacagatggcaacacgcggcgccatcagtccatgaccgtaagttggtgctgtcacgccatcaccacacagataaaagtttttcatgatccgttttgtgataatggtattgctgcttccatagccggccattccggttgcggatacgagctttttctctggaaaatgttccagaattccattgaccagcattgctttggcttccggattatcaaaagcttcgcagacaattgtggcatctgcaaataattcctgcagattatcgtccgtaactttcacacagtccgtgcggatatccagatacggattgatcctcagaagcagggatttcagggcatcggtcttgtacattccgatatgctccatgaaatattgctggcggttcagattggtaatgtcaactacgtcaaaatcaatcaggtgaagatgaccgacaccgatccgtgcaagcgcataagcaacattagagccaaggccgccaagccctgcgatcgctatatttcctgccgagagaagcttctgcgtctcaggtgaatgtcgttcgtcaagggcggtgtagatttcttcttttgtaagtgtatgatacatgatttcttagcctcctcctacaaaacttacaacctccagacggtccccgtctttgagcatggtgtcagaatagctgtattttggtaaaatatcaccattcatttcaacggcgatccgtttgatctgataattgttttgttccagataatccgcaacactgagcggtccggtcagagtaacttctttaccattaactgtaatcatggaaaaacctcctttcaaaacggaaaagttcttaaaaatgaaaaaagagtccacaaagaattacacccgtggtggtgtaccccttcatgaactctcgcccaatctcaactttaccttattcattttcgtgtaaaccctggttgaatgtggaatttcatgatgttggggtcaaaaggtattttgacccctttgataccagattgctacgtgctttgcactctcgcaatcctcaaaaacattcgtaatccgctcatttttctttgaaaaatggctacttactcatgtttttggcgggtcaagaggtcaaaaatcctcttgcaagcaagcttgcatcagctttctgaccttttgaccctggtatcatttcatattattataagaaatcctgtttctcaaatatcatcagagtatgctgatggtatttgacgccgtatatcaaaaaaagagagataccaatgtatctcccgttatcatcaaaatatacgttcctacgttggcattatccaaatcaggtatatgggtcgaagttctgaacttcctctcagcctgtcaaacaagctccccgtttcatttacaaaattcagtatagttcggttgagaaaaaatgtcaatatcaatataaaaatatatccggtcatattctggagtctcatattctggagtcagatgcaggtgtcacggacaaattgtatattacaggaatgctttcgagaagcggtcatatgtttttgtaacgcggagtatggaaaaatgcacaaaaaacagagcatactctaaaaaaatagtgtaaacgtgccgaaaatgccgaaaatccattgacaaacgccctttaaaggggtaaaacaccactatggcaatttgataaaagcttatcaaattaaaatactatataaaacaatttttactggaagagagaaagagagggataagtatgaatacattagttattgtactgatcgcagccgttttactttgctgtgcatatgtattctacggacgctggcttgctaacaaatggggaatcgatccaaaggcagagacaccagcaaagaaattcgcagatggaaaggattacgttccgacagacggctggacagtattcagtcatcagttttcgtcaatcgcaggtgcaggtcctgttaccggcgccattcaggcagctgtatttggatggcttcctgttttactgtgggtactgatcggaggcattttcttcggtgcggtaacagatttcggagctttatatgcgagtgtaaaaaatgacggaaagtctatgggacttctgatcgagaaatacattggtaaattcggtagaaaattattcttgttgttctgttggctgttcacacttcttgttatcgcagcatttgcagatatggttgcaggtacattcaatgcgtatacagaagtcgacggagctttaaaacttgcagatgcagcaaagacaaacggagctgcaggaactatttcccttttattcattgcatttgcaatggtatttggtctggtgcagaaaaaattccagttccgcggatggaaagaaacagttcttggtcttgtacttacagtagcagcgcttgctcttggtatgcttgcaccgatcacagcaggtaaagatacttggacttatatcacatttgtatatatcttctttgcagcagtacttccgatgtggcttttaaaacagcctcgtgatgcaatgacgacttatatgttcatcggaatgatcgccggagcagcacttggacttttagttgcacatccgacaatgaaccttcctgtatttacaggattccacaacgacacattaggagatatgttcccaatcctgttcgttacggtagcttgtggtgccgtttccggattccacagcctggtttcatccggtacttcctcaaagacagtatccaatgaaaaagatatgctgaaggttggatatggagccatggttctggaaagtcttcttgcagtcctcgcactttgtgtagctggtgcagctgcagcagcagacggaacaccggcagcaggaacaccattccaggtattctcaagcggtgttgcaggattctttgaaatgttcggagttccggtttatgtagcacagtgcttcatgaccatgtgcgtatctgcacttgcactcaccagtctggatgcagtagcacgtatcggacgtatgagtttccaggaactcttcagtgtagatgatatggaacatgcagaaggatggagaaaattcctttgcaatacctacttctcaacaatccttacacttgtatgtgcctatgttctgacacgaattggatatgcaaatatctggccattgttcggatcagccaaccagctgctttccgctctggtacttgtaacactttgcgtattcctgaaagtgacaggaagaagcaacaaaatgcttttcccaccgcttattatcatgctttgcgtaacaggaagcgcactggtagaaagaacaatcggtcttgtaaaagcttaccaggccggctcagcagtattccttgtagaaggacttcagctgatcatcgcagttctgctgatggcactcggacttgttattgtgatcaattctctgaaggcttactttggagctaagaaagagtctgaagcgtaggatttataaaatatgacgaaaagggatggcttgtcaaaatgatgggctgtctctttttttgattgactttttttaaaatctgccctaaaatacttaggaaacgaagtatttaatgcgaaaaatgataaagtaaaatatcataagtgcaagggaggttatcatgcagacaggaaagaagatcaatcagatttccaaccgtctccgtagacggtccagggcaatccaggaaacaatcgggatcagcggtgcacaggggaatattttaaattatattttagtagaatctcagaacagatctgtctatcagaaggatattgaacaggaattcggacttcgtccttccacggcaacagagacactgaaatctttggagaaaaatggactgataaaaagagagactgatccaaatgatggaagatataagaaaatcgtatttactgaaaaagcagagcagatagaagctgtgcttaagagtgagatcgaagagtcggaaacgattttgctgcagggagtgacaaaagaagaacggcaggaatttctgcggatcgcagagaaaatgttgcagaatctggatacttttcctgcgaatacggtaaaaaaaaacgcaggcagaaaaaaacaacacggaggacggacagatgaatgaaaatgacctgatgggaagtatgaaggtgtcaaaagccgttgcgaagatggcaataccaagcgtgatcagcagtctggtcacggttgtctacaatatggcagacaccttttttgttggacagactggggatccactgcaggtagcagcggtcagtctgaccaatccgatatttattttactgatggcatttgcaaatatgtttggtatgggtggaagtgccgttgcatctatggcgatgggagaaaaaaatgagaaacgggtaaagaatacatcggcatttgtaacctatgcatcactgatcgtcgggattttatttgctttgatcctgattttctttgtgaaaccgatcctttacacatttggtgcgaacagtcagacttatgagatggcaaaaggttatacatttcacgtttcctatggtgcaccatttatcatctggtcagcagcgtcaagctttatcgttcgtgcggaaggtgcaagcagtgaggcgatgatcggaagtatgatcggtacagttgccaacattgttctggatccggtatttatcagcggacttggaatgggggcggcaggggctgcgattgcgacaacgatcggcaatattctggcaagcatttattatctctggtatttcatgaaaaagagtaaaagcttttccgtcagtccgaagtatttcaaatgcggagagcaggttttatcaagggtatgttcgatcggttttccgaccgcaattttttcagcactgatgagtgtatcaacgatcgtgctgaatcagattctggtcaaatacggaaatgcaccggtggcagcgattggaattgtattcaaggcaaatatgtttattaccttccttcaaatggggcttgccaacggtgtgcagccgctgatgggttacaattttggggcaggcaaccagaaacgttttatggaagtggactgttttacgaaaaaatgctgtctggtcgttggaatcctggcgacggcattatttttcttttttcgagaaccaattatccacctgttcatcaacgataaagacgttatatattatggcgtgaaaatgctggtcgcatatatgctttctggaccgtttatcggaatcctttttgtaaatatgaactgcatgcagtctactggagatgcgcttccggcaacgattctgtcggtgctccgacagggacttctgttgattcccttactgtatctgctgaatgcagtgctcggattaaacggagtcatttacggacaggtacttacggattgcgtggcgattgtactgtccatgtatatctggggaagaaagaagagaaaattaaagagtgaataagtgagagaaaatcaggtgtctggtgtggtacctgatttttcttgcttataaatataacgtgcaaagtggaaagaatcattgcggacacgcatataatagtcaggtacaggaaataattcatctgaataaatgtaagaaagagaggctgtttatggaagagcgagatgatctggaacagatggcatttatacagaagtggaatgacggaaaggcagaacgggagaaaaagcgagagcagatgtggaacgggattctggagaaggctgggataaagaaagaagaaaagtaaaaaagaaaaatgatttttagaaaaaatgaaaagaactcaaataggaactcaaaatttaagtttctgtttgagttctttatttgagttcctttaacataatatagcaagaattctccttcctctgcaggtgggagatgaattgcacaaaaaacaaaaagaacatttgttcgataacgcaatccgtggtataatagagtcagtcgaaaacataagtaaacttaaatgaaaaactaaattccggttttggaccaaatgcaagagtaaattccatataggtagaagttacttttgcacacatatttgccatattgtctttgataatcattactccgtataatgtacttgcagctgattgcctgcctgtgcagattggagataattatgaaaaataaaggcaatcagaaacatttaacatttgaacagcgtgttgatatcgagaaaggtcttactgagaataaaagcttcactgaaattggacgaattattggtaaaaatccatctactatatcaaaggaagtacgtctccacgcacatacaaaagaacgtccggattcaggttacactcacccgccatgtattcatcgtaagaactgtaaggtgacatgcttgtgtgataagatgtgtggcattcattgtaagctttgcagaaaaccatcctttcgctgcactgatatatgtcccgcatatgagacagctgaatgtgagaaactgaataaaccaccctacgtatgtaatggctgtggtaaaaagacccattgtcttatgcccagatcgtcaagaccccgtccggctactggcagcaggtgccgcaggtgtccatcgcacagacctatctgaagattatgaacaagttcgcagagcagttcggcctgaccccgtcctcccgaagccggatcattgcttcggacggcggtccagttgatgcagccgatgagatggaaaatctgctgggaggaggtggaagctgatggcagagtgcagaccaaaaaactatccgaaactgaaagactataaacccagccggttcatgcttccgacctgccattacgatgccgccaaagcagaccgggcagtgacttttatcgaaaacctgcgccataccaaaggcaagtgggcgggcaagcggttctggctgcttccttggcaggagcagatcatccgggatgtgttcggcatcgtggatgaaaagggaaaccgtcagtttcgcacggcttatgtcgaaataggtaagaagaacggcaagtccgaacttgccgctgcggtggccttgtatctgctttttgccgataatgagccatctgccgaagtctatggtgcggcggctgaccgccagcaggcatccattgtttttgatgttgcccaccagatggtgcagatgaccccggcacttttgaaacggtgcaagatcatggcagccaccaagcgcatcgtgaactacgggaacgcaggattttatcaagttctgtctgccgaagtcggcacgaagcacggcttgaacgtgtcaggtcttgttctggatgaggttcatgcccagccaaaccgaaaactctacgatgtccttaccaaaggttccggtgatgcccgtgagcagccgttgttcttcctgatcaccacggccggcacggacaaggagagcatctgctacgagctccacatgaaagcccttgacctgctggctggacgtaagatcgaccacaccttttatcctgtggtctatggactgacagatgaggatgactggcatgatgaagccaactggtataaggcaaatccctcattggggcagaccattcagatccagcgtgtccgggatgcatatcaggaagcactggataacccggcagaggagaatgtgttcaagcagcttcgtctgaacatgtgggtgtcctcgctgacccggtttatcccggaacacatctatgacctcggcaatcagccaatcgatatggaagcacttaaaggccgtgactgttatggaggactggacttgtccagcactggagacatcacggcttttgtgctgatgttcccgcccagagttccagaggagaagtacatcatgcttccgtttttctggataccggaggacacgatcccccagcgggtgcgcagggcatccgttccgtatgatgtctggtatcagcagggctacctgatggcgacagaaggcaatgtcatccactacggatttatcgaaaaagtcattgaggagctgggcaagacctatcacattctggagattgcctttgaccgatggggtgcggtgcagatgacccagaaccttgaggggatgggatttacggtcgtgcctttcggtcagggttttaaagatatgagcccgcctaccaaagagttctacaagctcctgatggaagggcgtattacccacggcggcaacccggtcatggcatggatggcggggaatgtggtcgtggataccgacccggcaggcaatatcaagccgacaaaggcaaaatcgccggagaagatcgatggtatcgtcgctgcgatcatggcactggaccgctgcatccgaaacgaaggacagcagcagggaagcgtctatgacgaacgtgacatgatcgttttttgatatgaagatttggaggaaaacacaatgaagtatctgatgagtgcagaatggtggaaggcagccggcatccgtgctgcaaagacaatgttccagaccggcgcggccctggtcgtgacacagatgcctggcggcacggtggactggatggcggtcggcagtgcagtgatcgtggcaggtgttgcgtcccttggtaccagccttgccggtctgccggaactggaaaagggggataaggcttaatgggattctgggaatggatggggtttgagaatccaagggattctcccaaaacagaacagccaaaagaaggtctgccgaaggtcacggataacgtccgcgattccgggcagacctttgtgtttggccgctccaatgccggggagcaggtggatgagaaagcagccatgcagatcccgactgtgtatgcctgtgtccgtctgctggcagagtccattgcggcactgccgctgcatctgtaccggatgacagacgataacggcaacaaggaaaaggcgagggatcatccactgtataagattttgtatcgccagcctaacccggagatgacatcctttgtcttctgggaaacactgatgacccacctgctcctctggggcaacgcttacgcacagatcgtccgggatggcaagaacacggtgctggggctgtatccgcttttgccggaaaatgtcgaagtcgaccgagatgagagtggcgagctctactatatctaccacgcctacacggatgaagttccgggagagcagaacaaggacatctacttccgccgggacgagatctttcatgtgccggggcttggctttaatggtctgatcggtttctcgccaatcgccatgatgaagaacagcctcggtacttccattgcggtagataaatacggttcctctttcttcaagaacggcgcacagcccagtggtgtgctggagcatcccggcgttgtgaaagacccgaaccgtatccgtgatagctgggaagcggcttatggcggtgcagccaatgcccatcgtgtggcagtgctggaagagggcatgtcctataaaccaatctctcttccgccagaggacagccaattccttgaaacgaagcagttttccgtgacggagatctgccgcatcttccgtgtgcctccgcatctggtagccgatctgtccagagccacattctccaacattgaataccagtcactgaatttcgtgatgcactccctgaccccgtggcttgtccgcatcgagcagggcatcatcaaggatctgctgctggaggaggagcaggatacctactttccaaaattcaatgtggacggtctgcttcgtggcgactaccagagccggatgaacggttatgcgaccggcatcagcaacggcttcctctctccgaatgatgtgcatcgtctggagaacatggatctcatcccggcagaggagggtggtgacgactactacctgaacggcggctatgtgaagctgaaagatgcaggagtggcacagcagaataaagctgccgcagtccagcagaatcagaccaaacagacacagccagaggaacaagacccggaagaagaacctgacagcgaaaatcggctgagtgagagtaagccacgaaagaatgaaagaaggagaacccgatgaagaaattctggaactggatcaaaaacagtgacgacaccagaatcctccggctggaaggtcccatcgatgaggaatcattctggggtgatgagatcacgccgcagatgtttcgggatgagctggaatccggcgtaggggatgtgaccgtctggatcaacagtccgggcggaaatgtgttcgccgctgccgagatctataccatgcttaaggactacaagggctgcatcacggtcaagatcgatgcaattgcggcatctgctgcatctgttgtggcaatggccggtgatactgttcagatgagtcctgttgctatgctgatgatccatgaccccagcacggttgcgatgggcaacaccaaggacatggagaaagccattgaggtactgaccgaagtcaaggagagcatcatcaatgcctatgctgcaaagagcggactcagccacgcccgtattgccaacctcatgagcaatgagacctggatgaatgcaaagaaggctgtggagctgggcttcgcagacgagatcctctttgcaaagaaagaggaggagccggacagtgacccggcagacccggagaatccggaagaagaccctgacagtgaaccgggcgagggcgaagaaaagaagccgttccagaaggatacggcagggcaccttttctccagccgtcagatggatctaatcgtcctgaaccgtctgggtgtgaagccggaagatgtgggccagaaacacactgagccgaaggagcctactgctgacccgaaactgtccgcagagccgacccctccggcagaaccgtctgttaattccggccctgtccttgatatggacggcaagaccgaggatggcagtatcccctacaatatcctgatgaaacagcttgagtgcatgaagtgatgtgcattcaggctgtttttatatccaatcaaccatcacaaatttatggaggacaaacactatgagtaagattctggaactgcgcaccaagcgcaacactctctgggagcagaccaaggactttctggagaagaaccgcggcgagaatggtctggtaaaggctgaggccgtggagcagtacaacaagatggcacaggaggtcaaggacctgggtgcagagatcgagcgtctggagcagcaggcacagatcgaggcacagttgtccgcaccgacttccagtccagtccacgcggacccgaagaacggtgccaagaaggatgtcaagccgaccgccactgccgagtatgccgagaacttctggaacatgatccgcaaccgtggccattacggagaagttcgcaatgccctgtctgtgggtgaggacaccgagggcggctttaccgttcccgatgagttcgagaagaagctggtggaggcactggaggagaacaacatcttccgtggcctggcaaccgtcatccgcaccagctccggcacccgcaagattcctattgcagaggataccggtgaggcaagctggatcgatgagggcgaggagatcccggagagcgataccaccttcggccagaccatgctgtctgcgtacaagctgggcactatgatcaagatctccaatgagctgctgaatgattctgctttcgacctcgccacctatattgcccgtcgtttcggtgtgcgtatgggtaatgcagaggagcgcgcctttatcaccggtgacggtgtgggcaagcctctgggtctgctggcggagactggcggtgccaaggtcggtgtgaccgctgcccagaaggaggctgtgtcctttgatgagatctttaagctctactatgcactgaaggctccgtaccgcaagaaggcacagttcctctgcaacgaagccctggtgctgcagctgatgaccatcaaggacaacaacggcaactatatctggaagccgggtctggagatcggcaagccggataccctgctgaaccgtccgctgaagacttccgccttcatgccggagatcaagggtggcagcaaggtcatggcctttggcgattacagctactactgggtggctgaccgccagaaccgcaccttccgccgtctgaacgagctgtatgcccgtactgatcaggtcggtttcctgaccacccagcgtgtggatggcaagctgatcctgcccgaagctgtacagcttctgcagatggcaccgcagggctaagaaagtctggaaaggaggagccggttatggcactgatcccgctttacgaagcgaagacctatctccgcgtggacagcagcgatgaggatgccctgatcggcatccttttatcttctgcggagcagatgtgcaaggacgttggccgtttttcggaagaccagtgggaggcagtcaatgccgctgaccaggatgccgagaacggagtacagcccacaagggaactggaagccctacgcagcacctgtcgtgtggcgattctgtatgcactggggtatctctatgagcaccgggacgaagctgaccataagcagctgatgctgacgcttcgttccattctgtttgctgtgagggagggggtgttctgatgatcgagaaactgaatgagcggatcacaatcgagaaaagcacggtcgtgaccgataaggtcggaaaccatcggaacacatgggaggattatttcacctgctttgcctacgcttcgacctatcaggcacaggaagaagaaggtgaggtcacagccgaacagaagagcgtggtgtttacggttcgctggtgcagtgagaccagaggattaacttccactggttaccgcatccgcttccgggagcagctctacaatatcgaatccgttgacccgatgaactatcagaagaagatcctgaagattcattgcagactggagaggaggcagccggatgagcagaaccgtcagcattgatgagatggctgacgccatcaacgaaggcttaaaagaatatgcgacccttgcttctacgcaggtgaagagtgctgtccgtaagtctgccaaaacggtcaaagaccagatctcggccaatgcaccgtccagaacgggcgcatacaaaggaagctgggtggcgaccaaacagtccgaatccagccagagccttcagatggtggtgcattccaagaaccgctaccagctggcgcatctgctggaaaaaggtcatgccaagcgcggcggcggacgggtggcaggaagaccccatatcgctccggcagagcaggccggcatcgagcagctccagtctctcatcgaaaaggcactaaagtaaggaggaaccaatgacccacgaagaagtaaaagctctggtggaggagatggggcttccttatgcgtatgaccatttcgcagaaggggagagccctgatccaccgtttatctgcttcctgtatccgaaagctgagaactttggtgcggataaccttgtgtaccaccatttcaaccggctggacattgaggtgtacaccgactacaaagacccggatatggaagcaaatattgaagaagtcctgaccgcacacgaactctactatgagaaaagcgaggtctggatcgaaaccgaaaaaatgtatgaagtcctgtatgagctgaccgtataagccggccgcagggcgataggaggaataaccaatgtcgaagcaaagcaataaggtcaaatttggcctgaaaaactgccattatgccaaggcgacctttgacgaagatggcagcgtcacttacgcaaagccggtccgcatccccggtgcagtcagtctttctatggatgctaacggtgagatcgagccgttctatgcggacaatatcgcctattatgtcgtgaataacaactccggctacgagggtgatctggagatcgcgctgattccggagagcttcctcacggacatcatgcacgaggaactggatggcaacggtgtgcttgcggagaacgccaatgtggaactggaacatttcgccttcctgttcgagttcgatggtgaccagcgtcacatccgccatgtgctgtacaactgtgtagcaagccgtccgtccatcgagggtgagaccaacgaggacagcaaggaagtcaagacagacaccctgaacctgcaggcaacccctctggcaaacggttatgtcaaggcaaagaccggtactaacaccacggatgatgtctataacaagtggtacgatgcggtctacgagccgcaggcagaagccgtggacaccgaagacaccagtcacaccgaggagccgcagggctaagtgaccgacatacaccgcagggcttcggctctgcttacattattataaagaggtatatgactatgaagaagatttttcctttgttcgcagtgatcatcgttctggtactggctgtctgctcgttccacatcatccccaccggttacacgggcgtgaagaccagcttcggccagatccaggagaccaccatccagagcggcaagctcaacttctgcatcccctttgtgcagagcattcacaaggtcaacaacaagcagcaggataagcacatcgaagcacaggtctggggcgaagcctctgacaagacccctgtgtatgctgctgatgtcattgtgacctatcaggtgcttcctgagaagagtgcatggctgtatgcgaatgtgtccgacatcaagaatctggtcggtgacgagctggtggcatcggcaatcaagtctgcaatggctgaacttggccccaatgaggtaaccaaccgcaccaagatcgagcctctggcacagcagaagctggcagagtcccttgtgcagaaatatggtgaggacgttgtgtttgtgaacaaggtcgtcatcaacgacatgaatttcgaggatgcctataacgaagccatccagcagaagtccattgcacagcagaatgcagataagcagaagattgagaatgaagccgccattgccaaggcagaagcggataagcaggtggcaatcaccaatgcagaggcagaagcccagaagacttccattgccgcagatgcacaggcagaggcaaaccgcaaactggcagaaagcctgtccgatacgctgatcgattaccagaaggttcagaagtgggatggaaagctgcctactgtgagcggcggtaatgcactggtcagcattgacccggcagagtaagaaacacgatatacggcagggcttcggctctgccaattttacatgaaatttatggaggattacgattatggcagttacaaagaaaatcgagatcgatggcaaggaagttacctttaaggcaagtgccgctgtgcctcgcctgtaccgcatcaagttcggccgtgatatctacaaggacctgcgccagctggaaaagagcgtgggagagaatgatgaggataattccaacctcgacctgttcagtctggagatgttcgaggacctggcatggctgatggcccgtcatgctgaccccgcgaatgtgccggacagcccggaggagttcctggaccagttcaacaccttctccatttatcagatcctgccccagctgatcgaactgtggggcctgaatgtgcagacggaggtggaatccagaaaaaacctcgcaaaagtgagcgggaaatgaccaccccgctctttctgctgcgctgtgtacagctcggtatcagcatcgccgatctcgacctgctgaccatcgggttggtcaatgatatgttcacggaacggcagaacgacgattatccgtacaaagagctggcctctcaacacgatatggatgtcttttagcgacaaattctgaaagaaaaatagacgaccgtgcttatattgtaaatgaaataagcacaatcgtctggtgatgggtataaaaaatcccccagccgtgcacaactgggggagaaagaaggtggcccgaaggtcatcttcccggtctcggacctcgcaaggttaccgaaacctaatcactgttaaaagtatagccgatgtagtagtgctagtcaagcagaaagaaaaattaggcagtctttttagaattgcaatagtcatagagattcagaagatagtcggggctttctctccaaattccggtatcatagtcgaaaagtgtttcatatacctttgaatttgtgaagcgtaacagtgcatcttcataggaaatagtatcacgcaaagcgagttctttgaccgtatcgcgcatgagactgacagcacagctttctttctgcgtatctgtgaagttatagtttgacatctccatagcgatcactccttatatattcaagatgattaacggcgtcctgcgtgcgaaaacagaattggtcttttaggcgattgggaagaagtttttcaatagctattttgtctgctttcggtgtgccggggataccaaagtcaacgccaccgatatactgctgtaaggtgtgggctgtttggtcatctgcaatttttccaccgatgatgtcgatggtgccgtattttttcaaaagttgtgggaacaaatccttttttcggtttgctgctacaaaatgaagccattcaacagaggctccttggaaacagtaagctaatatgttgggatcgtagtggaatttgtaaacagatatctgtccgtcttccgggttgaaatcttttggaactgtaccaatacgcatcgctttcctaaccgaaagttgaacgtaattgtacgcttgttcgtaggaagatgtaagataaaaacctcggccaaaatcgagtccaccaaagcagcgattcaggtcgatcgccgggataccaatgtagctaccgtggtacagaagcatcccatcctgcaattcaatcatacggatacacctcgattctttaacaaggtttcaacatcgtgaagaacacaggcgtaaccgtttagatgaaggatgtcatagcattcagaaataaatccaagaatgtcgtatttcttaaaaagttcagcgcaatcgctgggagacattttccacttggactgagccatgcggaaaacccagcactgcatatcggcaatgtcaatattatattcactcatagagcgtacctcctttgagtacaatttctcaatttaagtatagctctttttctgtcgcttagcaacgacagaattgtaaatttcagattattttctgcctgtctgccccgtgcagatgggcttttttcatgcctgcgaggaggtggttacgcaaatggcatccagaatccagggcatcaccgttgagatcggcggcgataccacaaagctctccaaagcactggaaagtgtaaacaagtcaatcaaggggacgcagtccggactgaaggatgtcaacaaactcctgaagctggacccctccaatacagaactggttgtccagaagcagaagatgctcaaggatgccatcgaagccaccaaggaaaagctggcaactctgaaaactgctgcacagcaggccaatgagcagcttgccaacggtgagatcacccagcagcagtacgatgccctccagcgtgagatcgtggagaccgaacagaatctgcggtctttacaagaccaggcggcgaccacgaatgcgacccttgccaagatcgatgaagccggagaaaagctccagaacattggatcttctgtggagaatgtcggtaagaagttcctgccggtgactgccgctgtaacgggtcttggcactgccgcagtgaagaccgcagccgacttcgattccgagatgagtaaggtttctgccatttccggtgcgactggggatgacttcgaccagcttcgtgcaaaagcccgtgaaatgggtgctaagaccaagttctccgcatcagaggctgcttcggcgatggagtacatggccatggccggatggaagacttctgacatgctgaacggcatcgagggcgtcatgaaccttgcggccgcttcgggtgaagacctcgctacgacttcagatattgttaccgatgcccttaccgcgttcggcttatccgctgcggattctgggcattttgccgatatcctcgcagccgcttcctccaatgcgaacaccaacgtctccatgatgggcgagacgttcaagtactgtgcacctatcgccggtgcgctggggttctcggcagaggataccgcagaagccatcggtcttatggcaaatagtggtatcaaggcttcgcaggctggtacgtcccttcgtaccattatgaataacctttccggtgaagtgacctttgtgggtaaaaacatcggtgaggtcacgattgcgaccagcaacgcagatggcagcatgagaagcctgaacgatatccttgcggactgtcgtgtggcattctccgggctgtcggaatctgagaaggccgccaatgcggaagcactggtcggcaagaatgcgatgtccggcttccttgccctgatgaacgccagccagtcggatattgataaattaagtggtgccattgaaaactgcgatggcgcatctgagagcatggcagagaccatgcaggacaatttaaatggtcagctcaccatcctgaaatctcagctggaggagctggctatttcttttggcgatatcctgatgccgaccatccgtaagatcgtgtcggccgtgcagcagttcgtggataagctcaacagtatggatgaaagtaccagggaatcggtcatcaagatcgggcttctggcggcatccatcggtccgctgcttattgtgcttggcaagaccatatcgatcgtcggcacagcgatgcggggattcagttctcttgcaaagggtgtccggcttcttatcacccatgtgggcagtgccagcggtgtgttcagcaagctgggtgtggttctgggtggtctgtccgggccggtcgtagcagtggtggcggtcatcggcacactggtggcggcgttcatgaacctttggaatacgaacgaggagttccgtactgccattaccggcatctggaacgacatcgtttccaaggtgaaaggcttctgcgatcagctgacacagcggatcaacgggctgggctttgacttcaaggatgtcaccgaggtactgaaagctgtctgggatggcttctgtcaggtgcttgcaccgctgtttgagggagctttccagaatattgccaccatccttggcgttgttctggatacgctacttggtctgttcgatgtcttttccaatgtgttctccggcaactggagcggcgcatgggaagcggtaaagggtatcttctccagcatctgggacggtgtgaagtctgtatttaccactacgcttaccgcactaaagagcgcactggatgtgttcctcggtctgttcggtacggactggcagacggtctggggcagtatcaagagcttcttcgagaccgtgtggagcgaaatcagcagcttcttttcaaatacagtttctgccatccagagtgtggcaacgactgtatttacagcagtttcgagcttctttacgactgtccttacgagtatccagacgaccttcagcaccatctggactgccatttccacagcagtttcttctgtgctgaatacgatccataccacggtgacaactgtgtggacggcgatctcgaccgcgatctctacggtcatgaacaccatcagcacgaccatcacttcggtgtggaatggcatttacaacaccatcaagcctctgctggatgcgttcaaatatctgtttgagaccatctggcaggcgatccagatcctgatcggcgcagcactgaccgcaattcagacgaagatcacttccatctggaacgccatcgttgccttcgtgactccgatgctgactggattgcagacgactttctctacagtttggtcagcgattcagacagctatctccacggtgctgactgcgatccagactgcagtgacaacggtgtggaacgccattgtatccttcctgtctccgctgctgactggcatccaaaccaggatgagtacggcatggaatgcaatcaagacggtcatctcgacggtcctttctgcgatccagtccacggtttcttctatctggactgccatcagcagcaagatctccggagtggtaaatggcatcaaatcggtggtttcttctggctggaatgccatgaagtctacggtatcgtccctcagtaacagcatcaagagcgcggcaaccacagcttttaactccatgaaatccgggatttcctctacgatttccggtatcaagtccaccatcacgaacggttttaacagtgcagtttcctttatcaagggtctggctggacaggcgttctcgtggggctctgacatgatcggcaacattgtgtccggtatccagtcgaggattcaggatgtggcaagtgctgtatcgggagtggcagaccgtatccgttccttcctgcacttctctgtgccggatgaaggacctctggcagatatggaaagctggatgccggacttcatgcagggtctggcaaacggtatcacgaccaacaccagccttgtgactgcggcggcggagaacctgtccaccacgctgtctacctccatcaccaactccatgaggggtgtggagcaggcatacagtaagagctgggcagccatcagccagacggtgaaaaccggaacggcaggtgtgagtgctgcgatgagatccgcatggagttccattacgaccagtaccgccagcacatggaataccatcaagtccagtatccagaacagcttctcggtggtgaaatccaatgtgacctctgcgacagcagcagtgaaaacgtccatgaccagtgcatggaatgcggtgaagtcgctgacaacgaccagctggaacggaattaaaacggtcattaccacagcgtggaacgggattaaatcccttacaacctctgcgaccgcttctgtaaaaacgtccatgaccagcgcatggaatgcggtgaaaaacctgacgaataccagctggaatggtatcaaaacagtcatcacgactgcatggaacagcatcaagagtcttacaacttcctctgtatccgcagttcgcagtacggtcacaagcggctggaacacactgaaatctaccacgacctctgccttcaacagcatcaagtccgcggtgtcttcggcaatgtccagcctgcgcagcacggtttcttctggtgttgcaagtatcaggagcagttttaactcgctcggttcgattgcttcttcggcataccgctggggtgcagatatctgttcccagatggcgtcaggtgtccgggcagcagccggttccgtgatcgcagcggcagaaaatgtcgcaagcagggtcagaagtctgctgcatttctctgtaccagatgaaggacctctgtccgatgcagatacctatatgccggacttcatgaagctgctggcgaccggcattaagaaaaatgtcaagtcggtggtaaaagccgtgcagggacttgccgggtctatgagcaacaacctcacgaccccggtagattctctgggcgactggatagattccgtggtcggcagttttgctaccacgatcaagaaaagtcagagcggtatcggtagtgcggcaagggatgtgggcagcggtatccagtcccagttgatgtccgggctttccggtctgaaaacacagttccagcagctctggacggacctgcaggggattacaaaagccgctgtcggaaatatgggcaatgaggtgaagcagggctttgcggatatgaaaacatccatcggagagctgagttctcagaccagttcccttggaaatgcgatccgcagtcttggcgataccttcaactcggatttcttaaagagcctcggcaacagcatcagcaaggtcggtgacacggtcaatacggtcacgggtctagtggacaagctcggctccatgaagaacaccatcggaaatctcggaaatacgatgcagaaccttggcaatgtcctcggtacagagaacggcggtggtctgctgtccaacatcggagatttcttgtcgaaaatcggcagtgcagatggaggtcagatcgtgtcgaagtttggcaatctgatctctgggctgacctctaaaatgggaggtcttggggaaggcatctccggcatcatcccgaagctgggaagccttggctccagcggtgggggaatcctgtcgaatctgggcggaatgctttccggtgtggtatcgaagatcggcggcttaggcggcagtctttccggtatcgtatcgtctatcggttcttcgctgggcggtattgctgggacagtcggcacaacgctttccggtctgctcggttctgtgggcacgaccgtatccggcctggctgctggtgcaagtacagcccttgcaggggtagcaagctccgcaggtggtttcctcgcatccgcaggcacagcgcttgctggcttggcgggtcctgcaggtatcgcagtggcagccgttggcggcatcggtcttggacttaccgctctctggaaaaactgcgatggcttccgggaaggtgtcacaaatatctggaacaaggttacgtcggcattctcgaatggtgtgaatgccattaagaatggtatctccaatgcggcatcggctattggcaatgtggcatcgtccatttggggcggtatcaagaacgtggcttcttcggcagtcagctggggcaaggacatcgttggcggtatcgcgggcggtatcaagaaaggcgtgagctgggtcggcaatgcggtcaagagtgtggcaaatggcatccgctcgttcttgcacttctctgtgccggatgaaggaccgctggcagatgccgatacctatatgcccgacttcatgaagctgctttccggcggcatcaagaaaggcgaaggcggactgatcagccagatcaggtcgatggcagcaaaggtacagcagggtatggagggcatcagctccttcagtctgccggaactgaccttgccacatttcgatggctccggttggaacttcccgcaggcggctctggccggaggtggcaccacccggacgaccaaccttggcggtgtgtatatcacagtcaacggttataatgcccggaacgacgatgaactcgcacagaccgttgccgataagatcaacggcatgatccatgaggatgattcggtcttcaagtaaaggaggagatgcgtatgggctataacaccccaaagcaaacagtatcacagtttcagttaaaagacagatatgccagacagtatctgtcgtttgccgggaagtccagcaaagacttcctattatatttgtctggtcccggtgtatatgattccccggctgcggatgtggagagcacctccgtacccggcaggaacggagacatcctcaccgagaatgcaaaggcaggccgccgcagatatcagaacgtggatatcaagtataaagcttttttcttcaacggactgccagctaagacagcagcagtcaaggcatggcttctgtcgccggtggggtatcagaaattgcaggatacctacgacccggatttctttcggatggcggtctgcaaggatgcccttgcttttgatgtgactgctcagaaagccgctgagatggagctggcatttaactgtaagccccagaggtggagcgtggacgggcagcggacaatccggctggatggcaggtcgaccttaaagaaccccttcgcttttcctgcacagcccatcttcaaggtttacggagacagcggcggcgagctgtatgtgggggaagagaagatcaccatccacagcatcaaagactatgtgctgctcaactgtgagacgcacaacgcttacaacgctttcggcttctgcaatgagaccatcctttcggatgacttcccggaactgccggagggaaagacacagatcacatggacaggcggtatcacggcggtggaagtcattccccgttggtggacgctctgaggggaggtgcagccagtgatcccatgtttatatgattccagagaaatgaaatttgataataacggcattggaaagctgacagatgcacagtcttgtaccgtgactgaaaaacgaaacggtagctatgagctgaagctcatctgtccggcagatggcatccatgcagagatgctggaggagggaaacgtcatccttgccaaaccatctgatacgatgcagccgcagccgttccgtatctacaagatcacgacccctattgatggaaagctggaagttcaggcacggcatatttcctatcagctcaactttattacagtttccccgttctcagtgagtgggtgcgcaggagcggtgcaggggctgaaaagccatgcggcttccgactgtccgttctcagtttggacagatgtggcatccagtgcgatgtttactgtgtccgttccggcatctttccgaaactgtctgggcggtatggatggttcggtattggatacttttggaggagagttcgagtgggaccgctacacagtcaagtttcacagagccagaggtgcggaccacaacgttcatatcgtctacggcaaaaacctgacggatttcaagatggagaaatccatcgagaataccattacaggagtgcatccgtactgggtggacaacgaaacacaggcggttatggaactgccagaaaaagtggtcatggtcagccgaaaatctgtgccgtatcagaagattacggtgctggactgcaccagtgcctttcaggaaaagccatcggaagcggctttgcgagagtatgcacaggactatattgatacgaccagcctgacagagccggagatcgacattaaaatcgacttcattcagctttggaatacacccggatatgaggatgttgtacaggcagaacaggtctcgctctgtgatacggttcatgtgtatatctcgaagctgggcattgaagccagttccaaggttacagaaaccgaatatgactcgcttttggaacggtataacagcatcacgctgtcgaattctacggtcagcagccgaaattcctccctgacaagctcccttaacagtatccgaaatacagcaaccgccgcatacgataccgcagtccgtgtggaaacagcagtgggagagcagatgggcggcatttcggcctccattatctatgatggtgcgttgtttgctgcactgttcggccttcattataaaaatgagacggacagtaaggggaatacgactcggtacgcattcaacgcagcaactctgaaacagtcaacggttgcgtggaagaatagcccggccggattttttgtttccacagatggcgggaagacatggggatatggctgggagtcagatgattccgcagtcaaaacagcaatcctgctggagcagacactcaaggaactggacgaccgttacaagaaagcagccgagctttccgaggagttgctggaggaactggatgagcggtacaaaacagcgaccgctatttctgcagaacttcagaaaacgctcgatcagcggtatgaaacggcaaagaagctgtccaaagaactgtatgaggaactggataggcgatacagcaccctcacggaaatctcagatgatttgcagaaggaactggatgcgaagtatcagccgtatatccctgtgtccgaaagtgcgccggaagatccggcagaggattccttctgggtcgataagaagaaccttcggttaaaactgtgggacggagaacagtggcagacgattggatatgaaccggaagaacctgatccagagccaacggaaccgtccacaccgaccgagcctgaaaccccggataccgaaaagccgggtagtgaagataaggatacggaaaacaaagaggaaacagataataaggagacggatcaggaaggaggaagctcgtaatggtcacaggcatttatcaggaagtggaattgtcgctgacggagaatctgatcccggtgacggttccggtcaagcagtatgacaacaaggcgagaaaagttcgctgtgttttgtataacaactctgtggaatataccgtgccgcagaattgtattgtagcctgttccggtacccgtccggacggtacgatcttccactacacgagcgaaactgcgccagaccttgtattcgttgagaagggggcggtcctctttacgatcacgaccttcatgacggcgcaggccggacgttttccgctggatgttgttatgctcagcacagaaggtgatgtccttggctcattctctcttacgttaaaggtggagagggcggccatcaataacggcaagatcgccacttacacatttgcagcattcctgaaagctgttcgggatggcatccgaaatctgtttatagacaaggcaggctgctttggctttgagtcggatgacggtctgggactgagtgatagatcggagtccagttccgtagaaaagctgtgccgtgagattgtggaaggatcgattacggaggatggctattttgcatttgaaacaaaatgcgaccttgggctgatattcacaaccgatgaagaaggacatctggtcgtggaatatggcgaggatgatgtgtcagtgtaaggctgacagaaaggggtaatatggcaaaatacacaggccgccggatcgttcctaaacatgcaggcgaatgggacatccggaaagaatatgaagagttgcagatcgtactggatgcagacagcggcaacagttttatctccaatcttccagtgccgaaaggaacggctctgagtgatgagaagtattggatttgaagtgattaatgaggttgccatgcctcgcaaacccgcataaatactgaatgtgtggagttttgctcatggctatattaagatattaaggaggcgagagtgatgtttgaaaaattccatcgaggtgacatatattcggctcatttaagtcctggtatcggctccgaacaaagtggctctcgtcctgtactcattcttcaaaacaatgtgggaaattgtttcagtcctacgattattattgcagcaattaccagtgtaagcaaaaaaagcagaaagttccccacgcattaccacttaaatgacagatgcggtttggtgaaaccatctgttgttatgctggaacagatcagaacaatcgacaagtcgaggttaaaaaactatattggtcatctaaacaaggatgacatggaaaacataaacaagacgctcttgtgcagtctggggattacataaaagtgccaaaaggccgtatcattttcaggctgtgcaagtagagttataatttcgttaagaattgcggaggtgattctgaatggagaatatccagaataaaagcgcattgattccttcagatgaaatccggtcagaagaacttctggcggaacaaaaatttgaagcgtttatcacttcgctggcacatatcatcgagaaatatggtatgagagtgctgggcgaggttgacggagctgcgtgagaatcgcagctttacataggatattttccaaaagtaaattttggaggtatgaattatgaatcgatatggaaaacgctgtgttttgtatccgagggtcagcacagagatgcaagtggacggatacagcctggaaggtcaaaaaaatatgctgacacgatttgcggatcgtgaggaaatgatcattgttgatacttatgaagatgccggtaaatccggtaaatccattgagggacggcctgcctttcaaaaaatgctcagagatattgaggatggcttggacattgactatattttagtgtataagctgtcacggtttggccgtaatgcagcagatatacttaactctttggagttggttcaatcttatggtgtaaatctgatttgcatagaagaagggattgattcctctcagacaagcggaaaacttttgatttctgtactatctgctgtggctgagattgagcgtgagaatattatcgagcagacgatgaacggacggcgcgaaaaggcacggcaaggtggatggaatggtggctttgctccctacggatatacactggaagataacaagctgatgattgaagaaacagaggctgtggcaatacggaagatttttgaattatatacttcatcggaaatcggtttgggtggtattgcgaatcagttgaacttacaaggtatacggaaaattccgaggcagaatggcacattagaggattggacaggacattttattaaactgatattggataacccggtttattgcggtaaaattgcctatggacggagaacgaaggaaaaagtcaaaggcacaaaaaacgattaccagatgaaaagaaatgacgattacattctgacagagggacagcataaaggaatcgttagtgaggaggtatgggaaaaggctcatgccaagcgtcttagaaccggagtaaagcaaccgtcaaaaattgggcgggatcgagttcatttgttatcaggtctgctgaaatgcccggtttgtggaagtcccatgtatacgaataaacacgcatggacaaataaagatggcacttacaaagaaatttactattatgtatgtagtcggaataggatggtcaggggtaagcattgtgaatataaggcaatgctgaaaaagaccgatattgaaccgatggtcattgaggcaattcgtgagatcgtaaggaatgaggaatatgcccaggccattaaaaaacggattggcgttcagattgacacgaaagcagtggataaagaactggagggctatcaggcaaagctgaaggaagttgatctgaataaaacaagattggaacgggaaattgacagtctccctgctgatgcaaaataccgggaacgaaagctccatgatatgaccttgcggttagattccctatatgatgtcattgttgagctggaggaaaaaatcgaagatgccagacttcggcgagatgcaattaagcaacaggcaattactcttgagaatatttacaaaatcatggtgaatttcgactgcgtttataatataataaatgacgaagaaaagagaaatgtggtcacagccttgattaaggaaattgaaatttacaggaatgacgagtctgaatatccgctaaagcggattggcctgaattttccggtgttcaaggatggcggggaagttacggaacttttgtgggacaaagggaataccgttgagactgttgttcttttgtcccaactgaaacaaaaataatttacctaaaaatgaagatagcaggcaaccgcagtgtccagaagataaagagagtgcaattgtggaggcattgaagcattttaagatgaatagttaataaagagaggtgcagatgctatgccaggtatactcgtggttgaagatgatgaaaatttaaatcgtggaattacattctcactgaaaaaatccggatatgaggttttttcagcagaatcagtgaaaaaagcgaaaagaattgcaagtgataataatgtggatgttaccatttgtgatgtgaatcttccggatgggaatggactggaatttgtaaggtggatgagatgcaattataatacatacattatttgtcttacagcactagatcaggagatggatcaggtcatgggatatgaagcaggggcagatgattatattacaaagccgtttagtctttcggtacttcttttgaaaatagaagcacatttccgccgcagacaggagaaaacggaagccggaaagatgatttcgggagatatcgtatttatcgcaggagaaatgaaagtcctgataaagagtcgtgaaatcagtctgacaaaaacggagttgaaaatgctgactttttttctgcagaatccgaaacagattctttcaaaaacacaaatattggaaaatgtgtttgatctggaaggggattttgtggatgaaaatacaatcgctgtcaatatcagaagactccgtgagaaaatcgaagacaatccggctgcaccggtctatataaagaatatcagaggtcttgggtatatatggaatcaggaagtaaggcagtgacaaagagatatcgcaagaagattacagtagtgatctccttggtattacctgtcatattattgtttgcaatattaaattgctttaccacgtatgtgttttatgaagattataaatataaaatgaatcttatgacagagattgctgcaaaggaagaattttccggactggatgttgtttcggaattgcttaaggataaggatattgaaacgaacgaacagggaaggcaattattggagcaatatggatactggggaaataatgggaatacattttattcacaattccggcatcaggttatggtgaccggtgttgtaagcactttgatatgcgtgcttcttttgacctttttactttattggaagaaaaaagaaggtgcgttgcatcagaaaattttagaccagttggaagaaattctgatcagattccgtgaaaacaaatttgatgatttactgaaaacggaaaatcatgcagaactggaaaaattgaatgaccagcttgaagcaatcggacatcatattcagttgctaaaggaagaagcacgggcagaaaaggagaacacgaaagaaatggtttctgatatttctcaccagttaaagacaccggttgcagctttggatacatgttttagtgtgctgatgcagaatgacttaagtgccacagaacaggaggagtttcgtatccgttgtcggagtgctctggatggactggaaacattattgcagtcgcttcttgaaatatccaagatggaaactggactgattcagattaataagaaaaaacttccgcttatggatactgtcatatctgctgtgaaccgcacttatcctaaagcggatgagaaagaaattgaattcgtttttgactatgaaaaagagctggaaacatgcacgattatgcaggataaaaggtggcttggtgaagctgtgatcaacgttctggataatgcggtcaagtacagtccgtgtggttcaaaaatatttatccggttacaaaacagaaacgatcttgtaagaatggaaattgaggatcagggaattggtattccgcagaatgagtatcacaaaatttttcaacgattttacagaggaaattccaaggaggtcatggaaaagagtggtacaggaatcggactttttctatcgagagaaattatcgaaaaacacgcaggtacgattacggtaacctccggcaaaaagaaaaaaggaagcacgtttgtgatttaattaccatatgttggttaaattttaagtgagcagaaatcttacaattctgtaagacttctgctcgttttttgaaagtgaaatgaaagattgccctgatacaatttggatgtaggttgaaaaatgaccaaatatataaacaggcaaagaaagcgtgctgaaaaggtacgctttacagaattgaaaaggaggcaacacatgagtgtgatattagaaaccaagcagctttgtaagttttatggcgcaggtgagaatcaggtcaaagcggtcaatcaggtggacattcagattgagcagggagaatttgtcgcaattgttggaaagtcaggttccggtaaaagtacattacttcatatgcttggagggctagacaccccgacaaaaggcagtgttactttagcagggaaagatttatacaggatgaaggaagatgcccttgctgttttccgcagaagaaaaatcggatttgtttttcaggcatttaatctggtttcatctgttaatgtctgggaaaatattgtactgccactggggctggatggaagaaaagtggatgaagcgtatgtaaatgatattattgcaactctggggattgaaaaccggatttataatctgccaaatcagttatccggaggacagcagcagagagtagcaattgcaagagcactggtgaatcgtccggaaattatatttgcagatgagccgacaggaaatcttgattctaagaccagtgatgaggtaatcgctctgcttaagatgacagcaaaaaaatatggacagacaattgtaatgattacccatgatgacgaaattgcacaggtcgctgaccgtattctggtgattgaggacggacaggtggtggatttcagatgaagacaataagcaggattgcatatagcaatgacaaaaagaacaagacaagaagtatactgattatgatgtccatatgtctgactacgatgctgcttgtgattatcagtactgtgggaaatggaatgatccgtttacagaaaagtcaggcgacaggctcatatggaagcaattatggtctgtttgtttccgcagacggatcgcagttaaaagaagtaaaccgccgtgcggaaatagatgctacaggcactatgtgcaccgaaggtatcataaaaggcaatgaaaaaggcgggtttgtctgcatggatgagactgcaagaaaaatgcttccttataataaagaatatgagttgaaggaaggaaagtatccggaaaaaatgcaggaaattgccgcaggaagagcattttttcgtgcaatggggtatggtgatgtaaagatcggagatacggttacactggattaccgcgcagggatgcagtcagaatataagccggaagaatttgttgtcagcggaatcctatatgatcgggatgagtataccatcgaggcatcttatgttgctttcgggtcacaggagttttatgatgagcacgtcgcagagaatgacagacagtataatatttattttactttaaatgattctgcaaatgtatctatgaataatattgaaccggttataaagcagattgcagcatcttgtggaatcgaagaaaaaaatgttataatcaatgatttctatctgcaatgggtcttgcagccgagttatgaaacgattgcggtatgtggaattctgattcttgcaattgtacttttctctgttgtggtcatttataatatttttcaggtcggtattgtcaacaagatacaggagtatggaaaaatcaaggctctgggagcgacaaaaaagcagatgaaacaactgatcttcagagagggcatttttttgacatttttttcaataccggttggattgcttcttggttttctgattgcaaaatgcggttttaactggctggtagaacagggaaaccttgtatcaacccaaactggttctatgggagtccaaaatcagcaggtgccactgttttccctgcctgttatacttctatgtattttcgtatcatttcttaccgttgctttggcactgcgcaaatcaatgaaaattgtttcaaggatttcacctatcgaagcaacacggtatttagaaaatgcagaaacacacaaaaaaggaaaacgaaatggcagaaaaaatgtcaccgtgttttctatggcaatggcaaatataacgggtaatccaaaaagaaccattggtaccatcctcacaatggggttttcctgctcattgtttgtgattatctctaattatgtgggaaatattgacacggagcatgaagcacgtcgttacataaatcatggacaatttgaactgcagcttgactattctgctgagtatgatgaaaaatatccggagaataatctggatacgattctgacggatgatccattgaatgattcgctgattgaagaaatcaaaagcattccgggagtaacagatgtcatgccgagagagattgtctctgtaaatctgaacggaacaagatttccggctactattgtgagtaaaaaggattttgattttatgcgccaagaaggggatattggctctatggactatgatcaggcggtaaagaatggtgatattttctttggctggtcaacgtggatggaacaagatggatatgctctgggtgaatccattgcatttgactttgagaatggaagtggaacctatacctatcagggaaagattgcaggatcttttgtaagtgcggacacttatcttgtcattccggaaggtgtatatcgttccatgaatccgaggggaacagcctatggctatctgtgggtggactgtgataaaaaagatgtggcatctgtagaacaaagtctgaatactttgatttctaatacttcgcatataaaaatggatacttatcatgcgcggttacaatctgccgaatttgcaagcagcatgatgaagcttggctgttatctgtttatggcggttgtaggactcatcggttttatgaatatggcaaacaccatgatcatgaatattacgacaaaaaagcaggaatatggtgtattacaggctgtgggtatgacaaataaacaattaaatttatgtctgcagttacagggactgatttttacggttggcaccatatgcgtagctttgatcattggtctgccgctcggctatgcacttttttcctatgcaaaacataatggaatatttggaatgaatatctatcatgttccaatcgtaccaatttttattatgatttttttggtcggtctgttgcagattgtgctttcctgtgtcttaagcagtaatctgaaaaaggaaacgctggtagaaagaataaggtatcagggatagcaagtattgctgggatatcctcagtatcataacaggaattaaaagcacttggcttcaaaaagttttgtacttttgacaaaatgcaaccgatataagttttttgaaaactgtcgtttggtaaaatctattccatttttaaaagccttgcgataaaatatgttctgtgagacggttgtcttgctttccaagggaatggtcgatagcagaaaagtgaaggtggacttctatctggaggatatggatttatctgaatttaagggaaaagcaacttatgagcagataaaggcatatgtacttgaaaagacaggactgaaggtttcatcactgtatatcgcacagattaagaagaagtgtggattagatgtcgatgagaacttcaatccggctaaatcagagaatgcgagacagccacagtgtacaccggagaaggaagatgcgattatgcaggcatttagacattttggaatcatatagattgtggataagcagtatcatgtgttaaaaatatagtgaagtatggaaaaaaggacattccggaactgtagattttacaggtcaggggatgtcctttttgcagatatggaagtgttcaagggacaaggtaataatactgatgtattaagactgatttgagagatgtgtggatgttgtgacagcactgatcttaaaatatggaccggcaataaaaagaaaatggattttacgtgattggataaaaaacatacaggctgactgcttttggagaagtttagcctgtaaaagatatcagcggtatttcgattgtatgaaagctattgtaaaaaatgatgcaacatgacataatcggattgactaaagcaacatagatatttataatatagacaaaacgaaaatgacatgaacggaggacagggtaatggagaaaacggtaacacttgaagaggcattaaaaagaattgaggagctggaaaaagagaatgcagaacttcgggaggaattggagtattacagaaatcgtaagttaagcggtcgtcagaaacataacgccaagtggatggcaatttataatgattttgttgttgggtatgagagcggcatgacaatggtagaaattgcgaagaggaacaatgtcagtgagcggacgatttataggtataaagcgtattatgacaaactgagggaaaaagaggaatagaccattttactgacgtcagtaaaatggtttaatgtgggaggagaaagtctaatatggaaaagaaaatgataatgaattataagaaaagatttgatgaaattaggcatgaagaaaacggagttgaattttggtatgcacgtgaattaatgcatttgctagattattcaaaatggcaaaattttgaaaatgttttattaaaggcaaaagttgcttgtgcaaataatggcattgtagtagaggaccattttgctgatgccagtaaaatggttattctgggaagtggcgcaaatagagaagtagaagattatatgcttacacgttatgcatgttatcttattgcagagaacggagatcctcgtaaagaacagatcgcttttgcacaaagctattttgcagttcaaacaagaaaacaggaattgatagaagaaaggatttcttatattgaaagaactgaggcaagaggaaagcttcgagaatctgaaaaacgactgtctcaaaatatatatgaacgtggagttgatgatgctggatttggacgtatccgatctaagggggatcaggctttatttggaggattcactacaaaacaaatgaaagaacgtttaggagtgcaagataaaaggccgcttgcagattttttaccaacacttactattgctgcaaagaaccttgcaactgaaatgacaaattataatgttgaagaaaaagacttacagggtgagacggctattactgttgagcatgttgaaaataatacgtcagttagggatatgctggggcagagggggattaagccagaaaatttgcccgcatcagaagatattaaaaaattagaacgtagggtaaagagagaagaaaagaagttagctgagcagtcgggaaaattgacaaatgaataaactgggaggttaggttattgaaaaagaaaacaaaatgctacatatatactcgtgtatcaacagcaattcaggttgatggttacagcttggatgcacagaaggacaaactaaaaaaatatgcagaatttcaggatatctactgccatgcaggtggacgcgaacatgaagcaatccttagtgtagaagactggaaaactgcatagaaaataagaaaaagaactggtgttaaaagaataaagacaatcaattaacacaagaggagtttggcaaattatttcatgttaccaggcaaactgtttcaaattgggaaaacggaaaaagttatcctgatttgcaaatccttgtaagcatgagtaatcaattgttatgacgccgactaaatggattgaacagaatataaaatgtagtctttttttattccatatagctcgcacccagtactctttaagataaagtagaaataatgcaattttcacatgatattatacaagaattacatagaaatatatcgtattattgatatggtattcttgaattgtatgtgaggagaaaaactatggcagcggaaagaaaaacattaacacagctatctgtgccaatatgcttagaaactttattttatatgctttcaggtatggttgatacgcttatgctatcatctgtaagtgatcaggctgtaggagcagtgggaacagcaaatacatatataggtgtttttattattatgtttggagtaatatcatcgggtatgatagctgttatgtcacaaaatatcggagccggaagaccggggatagcgtatcaggcaagacaacttggacttatattcaacgcattgataggtatcgtaatgtctgtcgttcttgctactttttctggtgggatacttcgaatcgtaagtattgctccggctttgcttgagccggctgaaatatatcttagaattgttggcggcgcatgttttttaaatgcactgattcctattttctccagttatttgagagtgtttggatatacaaaacattctttgataggaactgttgttggaaatgttctcaatataatacttaattcagtatttttatttgcattcaactggggtgtgatgggagttgctgttgccacggttatttcgagagttgtaaatcttattattgtagccggcatgggggctgtacttgtaaaagcaaagcagagtcctgagcgaattacatcaagaaagatatttgcacagattgttaagattggttttccttctgcgcttgaaacagcactttacaacatcgcaatgacatttatagtgcgttttatgaatcagatggatgtggatggaatgaatgttacagcgcgttcatatgcgatacagattgcaaatttctcgtattgcgtgggagctgcccttgctcaggcaaatgcaattatgaccggctggagaattggagcaaaagagtttgaggaatgtaacagggggacgagaaaagctgcgatatatggtatcatcacagcgacatgcttttccgtgacctttgcatttgccggacattttatcgtgcatatatttacggatgatacacagatgataaatcttgtggtaaagttgttaatagtagatatatttcttgaacttggaagggtaacaaaccttgtatatgggcaggcgttaaaaacgagcggagacgcattttttccggttatattaggtgcgatatttatgtatttgtttgcagttggcggaacctattttctcggaatacacatgggacttctggctgtaggagcatatattgctatggcaggtgacgaatgtgcgagagcagtgggaatggtacttagatggaagagtggaaaatggaagagtaaaggtcttgtagaagtataggagagagtatgtactttgaattaaaggaaaataaaccacatggtacaaaggatgatccgtttagtacatatcatataaaaaatgaaggacgatcatttcagataccggttcattggcatgatgaactggaaattatatatgtaaaaagtggttttttgactgtaagtatatcaggagaaaattatattggaacccccggggatgcttttgtagtgtcgccgggtaatctgcattttatgggttcacagactggtacagtggattattttactttcctttttccgttaaaatacatatctttttgcataaatgacatgttggatgataaattattggagccgttaaaaaatggtcatctgatgataagtccaagagtaaaagatacagcaaaagaactatgtgagcagttggttgaaatatatgtggcaaaaaataagaaaactgagtccataataactgctcagataaagacaaaaataattcttttacagtttattcttgaaatgtgggagaagggctttgtaattgaaaatgataaaagcgggagaaatacgatagaaaaagaaatgatttcatatatacagcagaattttatggaaaagatatcattaaaagaatttagtgagcagtttcatctttcggaaaaatatatatcgcgatattttaaggaacattttcatattaccctttcgcaatatataacacatttaaggttagagcatgcaaaacagctgttacaagatacggatattcctgttacagagattgcaatgcagagtggatatcagaatgtaagctattttatcagaagcttcaaaaaaacatatggagtttctccgttaaaatatagaaaaaaataagccaggtatatggttagaaaggagaggatatcccggtagaatcagaaaatctgccggagagatatcgagaatgagtatgggaaataagaataaatggtggaaaaatgcagttgtatatcagatttatccgaaaagctttcaagattcggatggagatggaatcggtgatattccaggaattatcagcagattggattatttgaaaaaacttggaatagatgcaatctggctctcaccggtgtatcgttcgccacaggatgacaatggatacgatatttcagattatcaggatattgagccgatgttcggaacaatggaagatatggaacagttatttgcggaggcaaagaaacgcggaatacgaattatgatggatcttgtgctgaatcatacttcagatgaacacagatggtttttggaggcaaagaaaagcaaagacaatccgtatcatgattattatgtgtggcgtgacggagaagaaggtatttacccaaatgatatgaattctgcgttcggaggaccggcatgggagtgggttccagaactgggacagtattattttcatcagttttcagtgaaacagccagatctgaactgggagaatccgaaagtgagaagagagctctatgatatgattctctggtggatggaaaaaggagcaggcggatttcgtctggatgtaatcgatcagattgcaaaagagccagatcttaagatcacaaataatggaccaaagctgcatgaatttctgcgtgaactaagcagagaaacatttcagaagggggatatgatcactgttggagaagcctggggagcaacaccggaaattgcaaagaaatatagtaatccagatggcagtgaattttctatggtttttcagtttgagcacattatgcttgatcaggaagaaggaaaagaaaaatgggatacgattccattgaatctggttaagctgaaaaaatgccttgcaaagtggcagaatactttatatcagacaggatggaacagtctgttcatgaataaccatgatcttcctagaattgtgtcgcgttggggaaatgacggaaaatacagaaaagagtcggcaacaatgctggcgacaatgcttcatggaatgcagggaactccttacatttaccagggagaagagctgggaatgacgaatgtgcagtttgacagcattgaggaatatgaagatattgagacattgaatatgtacaaagagcgtctggaaaaaggatatcagccagaagaaatcatgcagtctatctacgcaagaagccgtgataatgcccgtactccgatgcagtggagcggggatgagaacggaggattcacaacaggagaaccatggtttgccgtgaatccaaattataccagaatcaatgccaaagaggcactggaagatgaaaattcggtattttactattatcagaagctgattcgtttaagaaaagaaaatccagtattcgtgaatggaaaatttgaacttcttctgccggaagatgagagaattttcgcctatacgagaacagatgagcatacaaagatgctggtatgtacaaactttacggatgaggaagttagctgcccattgcttgatgagtggaaagccggggaagtctggatccggaattatgaggacgacagagaaggaaatatattgcgtccttatgaggcggtgataattgcatttactggcaaatagattgagtttcttttttggcatcaaaattcacttactatatttcttcctgccacgctcatcaagaaagaatgcccattctctcttgaggtatttcggcatacggggcatagcgagcacctccttttcgctgcctaattgccgatttgttcccgaaacacagaaacgctcaaaaccgtttcccgctgtatagttccggaacgattttgggcgttttctttcgatatgagcggctttgttttgacggcggtatcctttaccgctaaccattcaaaagccgctgtttgtcacttccgggtaacaaaaaagcgccgtattgctacgacgcttttgtcttgctcggaagatggagcaagggaacgctattcaattatctattgtattttttcttcctgcttacaaccgttgtgccaatggctgcaccgccgctgatgaacaacagggcaatccacagtgcaaggttgcttgtatcgccggtctaggaaagtttggaatcgtctttcagtttcgccgttacggtgtcggctttttccaccgcttcttgccaataaagcgtatcggcttcttggggaacagaatctcggtataaaagccgacctcaagatagtttctgcagaaacggctcatatccttgacgataattgtgccgattttcccggcttcggcttctgcaagcattgcctgaaatccgggacggttgaagttacgccctgtgtaaccgtcatttttcaaaagattgtttgtaaaaaatttgtaatcctaaaaattcatataaactgtaatctatgttattctatagaaaagtaaaaatactgatgaagaaagcaggaggaaatttatgaacattgaattaaatattttggattggatccagacgttgcatacgccttttctggataaaatcatggtatttatcacaagacttggggatgcaggaattatatggattgtgttgagcatagtattgcttctgattcctaaaacgagaaaaagcggtgcggttatgatggctgctttagtagtagatgtattactttgcaatattgttttgaaaaatcttgtagcacggacaagaccatatgatgtgaatacaggtgtacaccttctggtagcaaagcttcatgattattcttttccgtccggacatacggcagcttcgtttgcttcggtaacagctttgtacctggcaggtgaaaagaagctttggaaatttgcgcttgtgctggcatgtctgatcgcaatatcgaggttatatctgtatgtacactatccgacagatgttcttggaggaattctgttcggtgtgatttcaggatatttgggatatcgcaaagtattgaaatgaagatgaccaaagattaccgaccgggaattatatggaagtcagttggtataagcatcattttacatgaattttacaaaaacagttctttaagaaggtagatatgaaagcgtattcagatgtataattaattcttaagcgtagctataaaatattcaaattagcaaaaggagataagtagacaaatgaaaaagaagcagttaaaaccagaaccatatatgatgaacagggaactgtcatggttaaaatttaatgagagggtattaaatgaagcagggaatccgagagtacctttagcagaacgacttacttttgcgtctatttatcaatctaatctggatgaattttatatggtgcgggtaggtacactgatggatcagatggaatcatcggaagtagtccgtgagaataaaaccaatatgaccagcaaagagcaggtaaaagcgatcattgatgcaacaagagagcttgatataaagaaagcagttatttacgagcagttaatgggagaattggaaccgcagggaatccggatcatcaacttcaacaagctttcaggaaaagaaggggaattactggaaacttactttgataatgaaattgcaccatatctgtctgcgaatatcatcagcaaacagcagccgtttccattcttacagaataaagagatctatgcggttgcactgcttgcaacgaaaggtgggaagacaaaaactgcgatcattccgtgtagcaataatgtgtttaagcgtctgatcgatatcccgaccagaccgggaacctttatgctttcggaagaactgatccttcattttctgccgaaattatttaaaaaatatgaaatcaaagaaaaatctctcctgagaattacgagaaatgcggatattgatacagaaaccatttatgatgaagatatggattacagagacgccatggaaaatctggtaaagcagagaaaacgtatgaatcctgtccgcatggaattctccagaaagatcaacaaaaagctgatcgcagagatatgtaaatatatccatatggataaaaaccacgtatttatgtcgagagtaccacttgatttatcatttgtatttgcaattcagaattatctgagaatgcaaggagcagaaaaggaaaagctgttctatcagaagaggagtccgcgaatgacaccgcagctgaaagaaaaagaaagtctgatcgcacagattgagcagaaagatgttctgttatcttatccatttgaaaatattaaatcatttaccaacctgctttatgaagcggcaagagacgattctgtagtgtccatcaagatgaccttgtaccgtctggcagttcgaagccagatcgtagatgctttggttgaggcagcggaaaatggcaaagaagtggtggtacttgtagaacttcgggcaagatttgatgaggaaagtaatattgaatactctagaaagctggaagaagccggatgccgtgtaatttatggtctgaatggattcaaggtacattcaaaactttgcctgatcaccagaaagacagataaaggtctggaatatattactcagatcggaaccggtaactataatgaaaagacttctactttatatacagacctgtcactgatcacagcaaagcaggaaatcggaaaagaagcggcagaagtatttgcatgtctgctgcgcggtgagacgatagaggaaacgcacatcctgctggttgcaccgaaatgtctccagaataaagtactcgatatgatcgatgaggaaatacgttacgcaaagaacgggaaagatgcgtatgtcggaatcaagatcaattcactgactgataaagtgatcattgagaagcttgtggaagcatcacaggtgggtgtgaagattgaaatgatcgtccgtggaatctgctgtatgattcctggtatcaaaggatacacagaaaatattaaagtaatcagcattgtcggaagatttctggagcattcccgtatttatcgtttcggaacgccggacagagaaaaagtgtatattgcatcggctgattatatgacgagaaatacgctccgacgtgtggaggttgcagctccggttctggatgatacgttgcgtgaaagactggactggatgtttgacaccatgatgaaggatgatgaaaaaggaaaagaactgactgcagacggcgattatgtagatcgtgatatcaatgaagaaaagctggattcacaggaagtgttctatgagacggcgtataaaaatgcggaaaagaaatagtagagaatatttgagcaaaataaacacagctgtagaaatgatacagctgttataaaatcagcagatacagttgacaaagagggacgtttgtgatattttaattaagtcgcaaacgtcatatgggggattagctcagttgggagagcgcctgccttgcaagcaggaggtcacgagttcgaatctcgtattctccactttataagaagtgcagcagagaaatctgctgcatttttgtgtgctaaaaaatatatcatcatttccatcttgcagagaaaagaaaaaaagaggaaaataaaatcatagtaaaacaagatggtatgattaccagaaaggaagattttatcatgaaagaaaatttaaaagtacttatgctcaacggaagcccgaaagcaaatggtaacacagccattgcacttcacgagatggaaaatgttttcaaagaaaatggtatagaagtagaaaatattgtaatcggaaaccaggcagtccgtggctgtattgcctgtggttcctgctacgaaaaaggcaaatgtgtttttgatgatgtggtgaatgagatggcaaccaaatttgaggcagcagatggtcttgtaatcgcaagtccggtgtactatgcgtctgcaaatgcaactctgatcgcctgtcttgacagactgttctacagcagtcattttgataaaacgatgaaagtgggagcaagcgttgcctgtgcaagacgtggcggatgttctgcgacatttgatgagctgaacaaatattttaccatttccggaatgccggttgcatccagccagtactggaacagcatccatggagcagcaccgggagaggccgaaaaggatgaggaaggaaggcagacgatgcgtacacttgcaagaaatatgactttccttatgaagagtattgcacttggaaaagagcagtttggacttccggaaaaagaagcaaagattccgacaaattttattcggtagaacaagtaaaaggggctgtaaaataagtccctaatataagaaacgccaattccggaaaatgtcggttttggcgtttctttgtattaactaaaatcgtaacttcaaactttatggaaactaactgccacgtcctacttttgaattaatgtgttttgctcatctctacatattataaacttctttttttaatatatctactacatattaaaattttattattttttcatcttgactttttattattacaattatattatcaaattaacatatttaattttttaataaaggagggattttcatgactaagaaagcaacccacaaaacctgtttcattctgttatttttgttcattcttcttactggctgctcaaccaaaaaagcatctgaatcagccgtaagtccggaagctgaagcagtactcaatgcgatgttcactgcaccaaatgatgacttgtattctttggattcttctactgtaatcggtgagaatagcacggcagattctgaaaatgcttccgttaattctgagaaaattctcgaaaactggaacaaacttgtaggaaaatactttgaaacgggacgattagaatattttgtttcaacctatggtcagacctatctgtcagaggcagctgttaataataccaaaatatctgtaaaagatatttcgcttgactccaaaacagatgattctgaaacagttcttgtgacttttaagattaataaagaaaaaatggtcgaaaaaatctatttttcttatgaccaggatggtttgataaaagacgtttatccaattaattttaaataatttataataaaggacacggcttcgccaagcgaaagccgtgtcctttattatatcttctcactactacaatatatttatggttaatatcccttacagccagtaaggaattatccatcttgttgcttaagctgttagaatgagtggagcaataggtctggcctccttctctcaggactttacgtccgtaaaatagtcagccaaccagccactctttcgcagcattcgttttatgcaggttgaaccttgatacgttcgtgtgaaacacccagtagattgaataggcaatgagaaaactggtattgaccattgctaatacattacaaaggagtatctgttatgaacgctgttggtattgatgtttccaaaggaaaaagcactgtcactatccgaaaaccaggagatgtggttcttatgtccccctgcgatatccctcacacccagtctgccataaacgacctgatcaaacagatcaaaagccttgaaggcgaaaccaaagtctgcatggagcataccggcagatactatgaaccggttgccacatggctttctgatgccggtatctttgtcagtgccgtaaatcctatcctgatcagagatttcggtgatgattccctccgcacacccaagacagataaagcagattctaaaaaaatcgcacgttatactcttgaccgttgggctaaactgaagcaatatggaatcatggataaaacacgtaaccaactaaaaactatgaaccgacaatttggattctatatggctcagaaaactgcaatgaaaaacaatctcattgcgctgatcgaccaggcttatccgggagccaatgatttctttgacagtcctgcccgcaatgacggcagccaaaaatgggtagatttcattcatacctactggcatgtcgattgcgtccgctccaagtcattaaatgcctttacggagcattaccagaattggtgcaaacgtaaaaactataacttcagtgcagagaaagcagcgaaaatttatcaaatttcctctgacctgattgccgtatttccaaagaatgacatcacaaaaatgttgatatggcaggcagtagcattactaaacactgcttcgaaaacagtagaatcgctccgttcaaaaatgaatgagcttgcatccacgcttccggaatatccggttgttatggatatgaacggtgtaggggcaacccttggtccgcagcttatcgctgagattggggatgtttcccgttttacacaccgggaagcccttactgcttttgcaggtgttgatcccggtaaaaatgattctggaaagcacatacagaacagtgtgcgaacctctaaaaaagggtctccctacctgcgtaaagctctttttcagatcatggacagtcttatcaaacgatctccagtggatgatcctgtttatgcctttatggataaaaaacgatccgaaggcaaatcttattatgtttatatgactgccggggcaaacaaatttctccgaatttattacggtcgggtaagagaatatctatccaacttgtcgaataatgaaattatttaatatcactttttaacttctaccagactagcgcatcgcggtggtcttattttcgtgtcttacgttcaacctgtataaattttcaaagttcattaatttctgcttgactttttatttgcagactattttttcaaaaacatttccatccttacagatgcagtaccctgtccttaatctcctgggtccttccctgattccagaactgggttccgatatatccacaggttcttctcgctacaaagagcttatcctgatcccggttgccacagttcgggcattcccataccagctttccggtctcgtcctcgatgatcttaatctctccgtcatagccgcagacttcacagaaatcactcttggtattcagctctgcatacatgatattctcataaatgtactgtaatacggaaagtaccgccggaatattggtctgcatattcggtacttcgatatagctgatcgccccacccggtgaaagcttctgaaattccgattcaaatttcaatttgctgaacgcatcaattttttcggtaacatgtacatgataactgttggtaatatagttcttatctgtaacgcccggaatgattccgaaacgcttctgcagacattttgcaaacttgtatgtggtagattccatcggtgtgccgtatacggaatagctgatattttctgcttctttccattctttacatttatcattcaggcgctgcataactgccagtgcaaatggcttcgcctccggatctgtatgggatttgccaagcatccgcatacacatctcataaagtcctgcatagccaagagaaatggtagaatatccgtcaaataacagcttgtcaatcgtctcaccctttttcagacgggcaagtgccccgttctgccacaggatcggtgcaacatctgaaacggttccgagaaggcgttcatgtctgcaccggagtgctctgtgacaaagctccagtctctcatccaggatttcccagaaacgttccatattgccctctgctgaacatgccacgtcaaccaggttgatcgttacaaccccctgattgaaacgtccatagaacttatgacttccgtctgcatttctctgggaatcttctacggtaaggaatgagcggcaccccatgcacggataaacatctccgtttttcagttctttcatgatctttgcagaaatataatccggcaccatacgctttgccgtacattttgcagccagctcagtcagataccagtatttggaatcctcggtaatattatcttcatccagtacatagatcagcttcgggaacgccggtgtgatccatacacccttttcattcttaacaccctgcatacgctgcttcatcacttcttcgatgatcatcgcaaggtcatccctggttcttccttccgggacctcatccagatacataaacaccgttacgaaaggtgcctgtccgttacaggtcatcagtgtgatcagctgatactggatcgtctggattccgctctgtacttcggtacgaagccttctctctgtgatcttgtcgatgatcgcatcatccagaacctctccggattctattctttcttcaatgacactcttgcggagcttctgacggcttacatctacgaatggtgcaagatgtgacagcgtaaatgactgtccgccatactggttacttgcaacctgtgcaacgatctgtgtggtcacattacacgcggtaaagaaactatgtggtttctcgatcatcgtctcgctgatgacagttccgttctggagcatatcctccaggttgatcagatcacagttgtgctctttctgcgcaaaatagtccatatcatgaaaatgaatgattccttcttcgtgtgcacggacgatttcctccggaagaaggactctcttggtaaggtccttgctgacctctcctgccatgtaatctctctgtgtagaattgatcacaggattcttattggagttctcctgctttacttcctcgttcatatgatcgatcaatgcaagaattccgttatccgttgtattcgactttctggttaattctctcttatagcgatagcggacatacttctgggcaacctcataaccacgcatctccataatgccggtctcaaccatatcctggatgtcctccacattcactgcatgcgtaaattcctctgcctgctgtgcaatcttctccgcaattgcaatgatctgaaagtcattcatcctgtggatgttctcaacctcttcattcgcttttttgatcgcattcacaatcttctccagccggaagtctacttcctcaccgtttcttttgattactctcgtctttacttccaaatccatcccaactttctcctaactttgttccatcgctccacaaaatatagtgtcacttttaagtttctccactatattttgcgctctgtagtatatgataccccatattcacgaaaatgaaaagggggatttttgttttttttatgttatttttttatcttgccattttccagattcggtcttaagaattcttctttcgcatactcccagatcgcttctgagccttttgacgtattccggttacggttcagaatctgttcaatatgaacatcgtgttcctcccacgctttgccgtctgtagccgcatttaacatgatcggctggatattgtccatcgtccgggcaaacttcgactcagcagtctcctgtgcctcaaattcctcccagagcgcccgaaattcctttccctgcttttccggaagaagtccgaaaatccggtccgcagccttcacttcccgttctctctgcgtcttcttcgcatcttcatcataggcataggtatcccccgcatcaatttctacaatatcatggatcaaaagcatcgtcactgtcttaagaacatcgatcttctcatcggcatatcccgcaagcagaaccgtcatgattgccatatgccacgcatgctccgcgtcattctccttacgcaccccatccgtcagatatgtctgccttccaataaatttttccttatcaatctcccgaaagaaattaaataattgcgtaagctcctctttttccacgtttttgctccttctatgatgaaatacactctatttgaacacctcaaaatcctttttctcagtacacgcacactgttatatattctaccacaaactaccctgtatcggaacttttattttgtaaaagattgtaccatttttcccaataaattttgtcaaaaattccgtattgaaaaagcgcgcaatctgtagtagattacgcgcttccacataaatttgtttcctatttaccatttttttcgcttcgacaccttcaaccggttcatcgcccttgaaagcgaagcctgtgtccggtaatattcctgtatactctgtttctggcgaagcttttcttctgcatactccatctgctcctgggcatgtctggcatcgatatcctccggtttctctgccgtctgcaccagcatcgtcacacggttgttgacgatctcaaggaatccggctccgaccgcaaggttcacccattcgccttcttcaaactgaagcattgcctcaccgatcaccacagcgatcaccatatcttcatggtgcggaagaatttccattccaccgccgtccggtaccggcacgatcatctttctgcaacgtccttcatagaatacccggtcactggaaatgattttaagtccaaatgtatccatacctggcacctctattctgctttttcagcctttgccttctcgatgacttcatcaatcgttcctacattgaagaatgcattctccggatactcatccatttctccgtcgaggatcatcttaaatcctcggatcgtctctttcagaggtacatattttcccggaactccggtaaatgtctctgcaacgaagaatggctgggagaggaatttctgaatctttcttgctctcataaccgttgccttgtcttcatcggaaagctcttccataccaagaattgcgatgatatcctgcagctctttgtatttctgcagaacctctgttacacggtttgcaacttcataatgttcttctccgacaatatccgcctccagaatacgggagttagattccagtggatcaactgccgggtaaataccctgttctacaaccttacgggagagtacggttgttgcatccagatgagcaaatgtagttgccggtgccgggtctgtaaggtcatcggcagggacataaacagcctgtacggatgtgacagaaccattctttgtagatgcgatcctctcctgcagttcacccatttcagttgccagtgtcggctgataacctacggctgatggcatacgtccaagaagtgcggatacttcggaacctgcctgtgtaaaacggaaaatattatcaatgaaaagaagcacattctgatgttctttatcacggaaatattcagccattgtaagtcctgtctcagcgacacgcatacgtgctccaggtggttcgttcatctgaccaaacactaaggctgtcttatccaaaactccggatgctttcatttctgtccagaggtcgttaccttcacgggaacgttctccaacaccggtaaagatggaatatccgccgtgctctgtggctacgttacggatcagttcctggatcagtacagtcttacctacaccggcaccgccgaacagaccgatcttaccaccttttgcataaggtgcaagcaggtcgataaccttgattccggtttccaggatttctacaaccgggctctggtcttcaaatgacggcggatctctgtggatcacccagtgttcggtatcttctttgatttcttcgccattgtcgatggtttctccaagtacgttgaacagacgtccaagggtctgctctccaaccggtactttaattccagaaccggtagcggttacttccatgtccttgcaaagtccttcacttgctgccagcatcagacaacgaacctcatcatttcccagatgctgcgcaacttccataatacaggtttttccgttgttctccacctgcagggcatctttgatgcacggcagatttccgtcttcaaatacaacgtcaacaactggtcccatgacctgtacaatacgtcctttattcatacctgttttcacttccttttccgtttctgggctttggcacctgcacaaacctcagtaatttcctgtgtgatcgcagcctgccttgccctgttatatataatagaaagatctttgatgatttcctgcgcgctgtctgttgctgattgcattgctgtcattcgcgcattgtgttcgcttgcatatgcctctaccagacatccatagatcataccaaccacgtagtttggtacgatgctgtccagaacagcctctgctgatggataaagcgcgatcgcctctctatggatgttaagcggcattttcatttcattaaatgaagatctctcaagcggcaggatcttcattttttcaaccgttgtcagcatcgaattttccattctggtgtaaacgatgtagacctcgtccagttcacctctctcatactgggaaagaatcacttccgcgatatctcttgccctgtgcatggtcggtttctgcacagtatagaggaaattggtgtcaatttccacacccttattcgcataatagtgtctgccaagctcaccgactacgaacagcttatgctctcccggttcctccaggatctcatcctccaccttgacaatgttgtggttgtaagctcctgcaagtcctttatccgcagtaatgacaatggaacctatctttcgtttctcttttggaatctcttcccgcacatcaaaataccggtgctcgatctcaggaatatgcctcaggattctggaaatctctccctgaagtccgtaaaagtacggctctgaatctgtcagctttttcttcgcctgtctcatcttggtagacgagatcatatacatggcgttcgtgatcttcatcgtatctttgacgctgttgattcgagtctgtatttctctgatatttgccatattaacacctgctgtctttgaattccttcgctgtttccacaatctttgcagccagttcatcggacagagcctttgtctgctcaatctcttcactgatttccggatgaactgttgcaaaataattcagcatatccatctggaatttcttaacctcttttaccggaattcccagaagcactttatttcgtgctgcgcagagggtgataaccatctcatgcatggacattggatgtccgagtggctgtttcagaagttccatcagaccagatccatattccagctgttcctttgttgctgcatccagatcggaactgaactgtgtgaatacttccatctcacgatactgtgcaagatcgatacggatacttccggctgccttcttcattgcctttgtctgtgctgcaccaccaacacgggatacggaaagacctacgttaaccgccggtctcattcctgagaagaacagatcactttccaggaagatctgtccatctgtaatggaaatgacgttggtcggaatgtatgcagatacatctcctgcctgtgtctcgatgattggaagtgctgtgatcgaaccgcctcccatttcatcgcttaaacggcttgatctctcaagcagtcttgaatgcagatagaaaacatctccaggataagcttcacgtcccggtgaacgtccaagaagcagggacagcgcacggtatgcaactgcgtgctttgaaagatcatcgtaaacgatcaggacatcttttcctttatgcatgaaatgttctgcaatcgcggttcctgcatatggtgcaatatactgaagcggtgcacagtcacttgctgttgatgctactacgatggtgtaatccattgcgccgccgtttttaaaagtattgacaacctttgcgatcgttgatgctttctgaccgattgctacatagatacagatgacatccttacccttctgattcaaaatcgtgtctgtagcaatggaagtctttcctgtctgacggtctccaatgatcaactctctctgtccacgtccgatcgggaacatagaatcgatagaaaggattcctgtttccattggaacgctgacggatttacggtctacaattcctggtgcttcattttcaatcggtctgtaatcttctgcttcgatttctcccgctccgtcaatcggagctccaagtgcatttacgacacgtccgataaatttatcgccaaccggtactccggctttctttttggtacgcatcactttcgtaccttctttgatctctacatctgatccgaacaggatgcagccgatcgtatctttctgaatgtcctgaaccatacctttcagtccattttcaaatgtcacgatttctccgtacattgcatgctctattccatagatatttgcaattccgtcaccgacagagacaaccgtaccgacctcgctgtctttactgatctgatcaaagttctctatttcatttttcagaatagaaataatttcatctgagctaattgaactcactttgttcacctccaggtcaatttttgctctaatctcgataatcttcctttcagactccagtcatattcatcatcaccggtctttaagataaatccgccaagtaatgccggatctttgactatctcgatcttcacatctgtcttatggtacttctcacaaagaaattctctgattttctcaagccgcttttcatctggtgcttccacacaggtaagcgttgccatctggattccttcctgcattttacagtatctgtcataagcaaaaagaatctgactgatctcgctcattctctgattacggcatacaaccttgagaaagttttttatttcttccgggaaaatcttgtcgatcgaacttaatttttcccgcatcggtaccaccggacttgcaaatgtttcttcaagcaccggtacttcttcaaaaagcttttcagtctctcctaccgcttcttttgaaattccaagctcatataaaacatgtgcatactgttttgccgaagggctacagcaatactctttatttaacctctttattgacatgagcatcacctgcacctttcagaaactgatcatatatatcctgatttccttttgtgtcatccacaatcttacgtgctgcctgcattgccagtcctgcgatctcactttgcagatcattcatggtctgtttgcgttcattttcaatcgtctttctggcatctttcaggattcctacggcttccgtattggcttcctgaaggatacgctctgattctccggctgcagttttcttagctttttccacgatctgaatggattctgcctttgctccttccagagccttttcatattccgctttcagtctcgccgcttcttcctgactatcactggcatttttcagtccgtcagcaatcattttttcacgtttttccataattcccattactggtttgaataagaattttttcagcaaaagataaaagacaatcaggttgatgatcgtaaagagaaggcttacattaaactgtatcacctgtcccacctgcctttcttcattttacttttcttatttcagcattaagatgataagaagtccgataatgaaaccgtaaatagcggttgcctctgcaagtgcacaaccaaggatcaggttcttgctgatcttgctttctgcttccggctgtcttgcgatcgcgtctactgctttacctgttgcaaggctgattccaagtcctgctcctaaacctgttaaaactgctactgctgctccaattgctactaacataatcttaatctccttttttcttatagatttgtgtttcttctgtcatttcgggattattcctgctcctcattcatgaaaagtgctgtcaggaatacgaatacatatgcctgcaggaatccatcgaaaatatcgaagtaaaaactaaatggtatcgggataagaaccggagccactgcttttaaaagctccatgataacaaacgctcccaatacattaccgaacagacgcatgcaaagtgataatggtctgatcacaatctccagaaccataattggtgctacgaatggtaccggctttgcaaaatgcaccgcccagtgcttaaatccattcttccggattccggaaaattcaatcaggcacatactcatgatcgcaagtgctgctgttacattgaggtcttttgtcggtgacttaaatccgaacagaccaatgatattggctatcccaatatagataagcactgtaatcagatacggaatatatttcctgttttcttttcccatgatgtcttcaaagaagtccagtccttttcctattgcggattccaataaaagctgaacctttcccggattttcgacgctcaagcttcggacaaatatgatacaaagtcctacgattaccgccatgatgatccaggtaactacgaccgactcttttaccggtattccgccgaatatcgggatcgtaaacactgtctcgcagttcagctcttctaacagagtctctgttaaatgttccgtatcgctccctccctttcgttttatttattcttattttatagtacttttcagagcgtcctctaaaagtcatgcttatattacgctcacactttttctttgtcaatattttcagcttttgtagattgtacagtaaaaaaaccaatttttttatctattttcactatcttcatctgtttttcttttattttctttagctgtttttacttctattttttgacactttttttagtttgtagcattcgagattcttttttgacggattttgtgctttcgtacagttgaatttttggcattttttacaattattttcttttatttttatgcactatgtatagtgactatgtcgaatatatatatctagcgggatgattattttgtttttggaaatgaagagttgatttggacttgcgctatcaccattccgcacttggtccattagataaaaaaaggactcaaactgagtccttcaagttacaggggatgacagaatcgaactgccgctaagagttttggagactcctgtcataccatttgaccaatcccctatatgaaattgttgattgctgaagcaaccatggactataataacacaatggctgcttcctgtcaatcatttattcaatatttcctttgcgccctttgcaaataatttcttcgcgcaggtttcacttacagattgcccctgctgatctgatcgatctttttcagttcttcccgggtgaacttcgtattctgcacaatctccacattctgaatgatctgctccggtctggacgctccgatcagcacactggtcacatcctcatctttcaggatccagctcagtgccatctgtgcaagagactgtcctctctcacctgccatcttgttcagagcctcgatctgcgcaagcttttctttcgtcaatgcatcggcatgtagaaatcttccatccaccgcaatccggctgtctgacggtattccgtgcagatatttatctgtcagaagcccctgtgccagcggactaaatgcaatgattccttttcccatctggttcgccgtctttttcaagccgttctgttcaatcgtccggtcaaaaatggaataccggttctggttaatgacaaacggacatttcagatcttccagaatctccgctgcacgtaccattgtcggaccatcatagttagaaattccgacataaagtgccttcccactctttacgatggaatcgagtgctcccatggtctcttccagtggggtattcggatccattctgtgatgatagaagatatctacataatccatccccattctcttcaggctctggtcaaggcttgcgatcagatacttcctgcttccccagttcccgtaaggtcccggccacatatcatagcctgccttggtactgatgatcatctcgtccctgtatggtgcaaagtcttcttttaaaatcttcccaaaattcgtctcagcacttccgtattccggtccatagttattcgcaagatcgaaatgggtgattcccagatcaaatgctgtcctcaacattgccttcatattctccggatccgcattggttccaaaattgtgccaaagtcctaaagaaactgccggcagcaaaagcccgcttttcccacaacggttatataccatggtatcatatctctcagatgatgctgtatacataattcattttctccttcattatctctgaattgaaactttactatttcttttacagatttctcttatcagatatgatacctttttcctgcataaatgtccagtaaatcccggcatctgccctttttctgccggaaaacgggattctttttgtaaccgtcagccggaaattacatctgtctcagaagatttaccatttcgattgcagaaagtgcacagtcatatcccttatttccgcctttacttccggctcttgaaattgcctgctcaatattttcagtcgtgatcacaccaaataataccggcactccggttgcaagtccaacctgtgcgattcctttggatacctcattgcagacataatcataatgcgtcgtgtctccacggatcactgctcccacacagatcaccgcatcatactttccggatgccgccattttagaagctgctgtcggaatctcaaatgctcccggtacccatgctgccgttatgttttcatcctccacgccatggcgtaccagcccgtctaccgcaccaccaagtagtttattaacaataatctcattaaatcttgaagcaacaattcctactttcattccttctggtgctactacttttccttctaatacattgatctgtctcatgtttttttcctcctgtaattaaagtgtttcttctatgataaatactgtttattctctttttactgaaatttgatttctttaaagatatgtcccatcttttcctgcttcgtcttcatataaaatgcatcaaatttctgcggtgctatttcaatcggtactctctcatggattgcaagcccgaaaccggaaagtccatataccttctccggattatttgtaagaagccggagtgattttactcccagatccgatagaatctgagcccctacccagtattccctaagatccggtgcaaatcccagacggatgttggcttccacggtatcgtatccctgttcctgaagttcatacgctttcagcttgttgatcagaccgattccccttccctcctgtcgcatatacagaagaactcctcttccttctctctcgatctgctgcatcgccgactgcagctgctttccacaatcgcagcggagagatccgaaagtatcgccggtcaggcactcggaatgtacacggcacagaacatcttccccatcgccaatctcacctttcaccaatgccacatgatgttcaccggtgatgtcattcacatacccataaatctgaaattctccatactgggttggcatctttgcacatgcttcccttacgacatgtttttcatggatcctgcagtaatcctgcagatctttgatcgtaataaatttcaggtcgtacttcttcgccagcttccagagattctctgtccgcatcatcgttccgtcctcttccatgatctcacagcagattccacattctttcagtccggcaagacgcatcaaatcaaccgttgcctcggtatgaccatttcttaccaacacacctccatgccttgccaccagcggaaatacatgtcccggtcttcgaaggtcctgcggtttcgttccttcttctgtcaggctgcgcatagtatatccgcgctctgctgctgaaattcccgttgtcgtatccacatggtcaacggataccgtaaatgcagtcgaatggttatctgtattttcggagaccatctgtgaaagcccaagccgtccggccagcgctgcactcatcggtgtgcagatcagccctttcgcatggcatgccataaaattgatattctcctgagttgcaaattccgccgcgcagatcatatctccttcattttcccggtccggatcatccgttaccagaacgatccttccccggcgcaattcttcaagtgcctcttctacgctattgtattgatactgtttctccatttgttacttcctcctgtccgatctataacttatttttatcctgttcttctgtatgctttccattccggtcccggaatttcttcgcatcaaattccatactcctctaataattccatggtaagtccaccacattttccagccggttccgatggtgtaagaaactttttaatatacttccctacaatatcattttccagattcaccctgtccccagcttttttcttcagcagtgtggtctcctctccggtatgaggaatgactgatacctgaaagcttttttcacttacttctgccactgtcagactgatcccgtcaatacagattgaacctttttctacgatcagttccagaatctccggcgttgtccggatttttacccataccgcattttcttcctttctgagttcttcaatcattccggtcccgtcaatatgtcctgcaacgatatgtccaccgaatctaccatctgccgccatcgcgcgttccagattcactttctcaccgatcttcgtatcaccaaggttggttcttctcactgtttccgccatcacatctgcggtaaatccatccttttccagagaaaccaccgtcaggcagacaccatttaccgcaatactgtctccgatcctggttccaccgagtactttttttgcccgtatcgcgatcttcccggatgatccagaaagtcggagtgaccggatagatccggtttcttctacaattcctgtaaacatttacatttcctccaaaaccttatactctgccagaatatcttctccaacctgcgagattctcgtaagctgtagcttgatggcatcgtctactttctcaactccaaagccttccaccggagtcttgccgcctcttccgccaaaaattttcggtgcgataaaagctttcacctcatttacgataccggattgcagggcatcctcatttaaagttccaccgccttcaataagtacactgtcaattcccagctctccaagctttctcatcagaagctgcagattgatctcccctttttccgaaggaacgctgagaagcacgactccaagcttttccagactgcgttttttctcttctaaacaaatcgtattccccttttcaccggcatatgcaacgatcgtccggtatctccctgctgtctggcagatctgactgtccagtgggatcctgagcatactgtcacagataattctgaccggacttttctttccctccagacgcacattcagcatcggatcatctgccagaaccgttccgattcctgccatgatcgccatatagtcatggcgcatctcatgtaccagacttcttgcttcctcaccggatatccattttgatgctcctgtttttgtcgcaatctttccgtctgccgtcattgcgtatttcatcaccacatagggcagccctgttgtgatatagtggaaaaagaccggatttaacgcatcacattcttcgcgcaggaaatcctcttccacctggacgcctgcctcgcgtaaaatctttgctcctttgccggacactttcggattcggatctctcgatccgatcacaacccgtgcaatcttctgttccagaatcgcttccgtacatggtggtgtcttcccataatggcagcacggctccagcgtcacataaagtgttgctccctcggcgctttctgtcagggatgcgattgcgttccgttctgcatgaagctcaccacatttttcgtgatacccttccccgataatgcttccattctttacgatcacggcaccaaccatcgggtttggatttgtccatccacgtcctttttttgccagttcaattgcacggcgcatgtaaaattcatctgtcattttttctcctttctcatctctcccggaaacgttctccggtaaatgtactctgctaaacattttagatatgttgccggataagtctcttttcaaaaatgtgctttggcatataggaaaagccctgacagattctcttacctgtcagggctttctttctcagttatatcgctgtacgctctgtcatacttctcggaaataccattttctcatcgaatccggcctcggcattttattttccggaaaataaaaactctggaatgattcccattccagagcgttttactttttattcctgcatatatgatagaaaccgcttttatcagcaacgattcaacttcttccatccagactttactgtcggcactggaatctcaccagttcatgccttacggctcgcgggctttaccgccggtggggaatttcgccccgccctgaagcattatttggttttacaaaacttactatagcacgttacagcagtaattgcaagattattttttcgacaaacccgtatgtttatgctattcttatatggagatatcagagtccgcttattaccaggctggtacagatggttatttcatttaatctggctttaagaaagacgaggaattcaaaaacatgtttcataaatttttaaaatacatttcccagagtatttccggaatgatcggtgtctccgtctacattctggcagataccttttttatctcttacaaatgcggtgcagatggacttgctgccctgaatctgatcctgccggtgttcggtctggtcttcgcaatcggttcgatgatcggaatcggctccgccacacgatacaatatcagcacagccaaaggttcaccttcggactactattttacccagtccatcttctggtgtctcatatgcagcattccttttatgctcaccggaatcttcattccgcataaagcacttgcacttttaggggcagatgccgggctcatccggcttggacgtaattatatgcgtatcgtcctgctctttaccccgttttttatgtcaaactataccttcacggcatttgcgagaaatgaccatgcgacttctatcgccatgatcggttccatttccggaagcttctttaatattttatttgactatattttcatgttccctttgaatcttggatttctgggggctgcacttgcaaccgctctttcaccggttgtgacgatgctggtatgttcgacacattatcttggaaagaataaccatgtagagtttcactggcgcaagccctctcttcgccggatcattggatgctgccagcttggtgtttcttcattttttgctgaaatttcttccgctgtcattacgattatatttaacatgctgatcctgcgcattgcgggaaatatcgggatcgcagcctacggcgtagttgcaaatatttcactggtcgcaatggcgatcctaaacggacttgcccagggtgcacagccgctgatcagccagagttacggaaagggtgaacatgatctagttcgtaaatttctcaactggtctcttgctgcagcacttctgatcgagcttgtgatcgttgtactgatctacggatttacggatacctttatcagtatctttaacagcgaacataatctccagctgcttgcttacgcccatactggtcttaggctttatttcctgggctttttagtcgccggtatcaatatttgaagtgattaatgaggttgccatgcctcgcaaacccgcataaatactgaatgtgtggagttttgctcatggctatataatatggtaataggaggtgattatatgtttaaaaagagattaacaaataaacaaatggatgtaatgaatattttatgggaaaatgataaaccaatggctgcatctgaaatcttgaaagcaaatgaaaaattaaatattaatacaattcatgcatgtattagaaaattattagaagaagaatatgtaaaagttgcatatattgattatagtggtaatgttatgagtcgatattttatgccaacagtttctaaaggaaaatattttagtgagagctacaaagatattattggatcaaaaaaattgatattaacttctttaatagaaacggaaaccaatattgaggaactcgaacagcttgaaaatttaattaggaagaagaaagaagaattaaaggagtagccagatatgtcattgtcattgggaccttttatcacatgcttcttgtgtacaaatattctctgcataatattacattatctgatatataagaaaaaaatattttttgataaaagtttacgttttatattctggataataggaattatattactaaggatggtacttccatttaattttccatttacatatacttcttattcagacaatattttacccaaaatagtagatttcatttattataaattacaacatgggaaaataatgatattagatattggtttgattatctgggggataggaagtatatttcagatcataataatgatacgaagtaatataagattacgaggatatgttaaaaatcatgtgattagtatggaaaatccaatagcagaagaaataatagatatagtacaaaatgagttactttttgaaaaaatagaagtagctgtattgccagagtttgtatcacctgcaattattggtattaaacaaccaatattaatcatttcggaaaaatattgtttttcaagacaggaattaaaattggtatgtgaacatgaaataaatcattatataaaaggtgatttaatattaatggcaattataaatattgttagttgtatacaatggtggaatcctgtaattcattttttaaaggaagaactaattttagcgttagaactatctaatgatttgcaaattatagaaaatcaatctgatgctgaaaaaatagagtatgcagaattaattttaaaaatagccaaagaaaaagagtattttaaaacaattgatagaagttttgttacttgttttgtcgggaaaaataaaacgaatttaaaaacaagaatagattatatcttaaaaaagaatgagaagaaaaagagtgtagtgtatataattaacacattgatgataagtgtaatgttattgtctgttttttgggttccggaagcaacacatccgatagatccagataatcaggaaaattcaatagaaatgtctccgcaaaatacatattttctaaaaaagagagaaggttatcagatatttgtaaataataaattgtggggagaagtgaaagagattccggatggactggagaatattcctatacgaaagagtgtcagacattaaatattatagtatgggtaaactttttttaagacatttatgatttactttttcaatcataatgcgtactcatcctttgtgtgaaaaaagctttcacctgatactatcagaatagtacagacagaaagtgatgtcaaagaaatacggttgattttcgggtgcgatttgctataattgataagaagagtaagaatggacagcagagtagtactgctataatgagaaaaagggaagtataaagatatgaattacggaacaatcaaaaattacgatatcgcaaatggaaccggcgtcagggtcagccttttcgtatccggctgccggcatcattgcaaaggatgcttcaattccgagacctgggatttcaattacggcaatccatataccaaagaagtagaagcagagatcctcgaagcactcaaaccggcatatatccagggattttccctcctaggcggcgaacccttcgagccggagaatcagaaagagcttgccggactcctgcaaaagatcaaagaaagctacccggagaaaaatgtctggtgctacaccggatatctctatgatgtagacctcatccccggcggaaaagtctacaccgaatacactgacaagatgctcgcctgtatcgataccctcgtagacggcgagttcatcgaagccgaaaaagatctcaccctggaattccgcggaagccgcaaccagagaatccttcaccttgatgaaatccgccaaaatgcgaaaaactaaaataattcattgacaaaaaaagaccactgtgatataaataacaagtggtcttttttagatcataaaatcaaataggggattggtcaaatggtatgacaggagtctccaaaactcttagcggcagttcgattctgtcatcccctgtagaaacctctcggaagtagttccgggagattttttatactctataattcccaccagattcaattgtttgcacaaagaatctggtgggaattatttttgtctgatgctgacataacctatatttttgtaaatcaatatatttctttagaaattaaaataaagttcgtacaccttaaccggccgccccttcgcattggtcgtctgcgtataagcgagcttcgcgactcctccattttccagattctgaataatccggttcgcatttctcaccgtacttcccatacgttcggcaagctcgtgcgttgtaattttatttgatccggcagcatgcgtactggcaaggactttcttgatcgtaaccggtgaaagattacactgctttgcaatctttccaagattctgcacatactgattctggatcactcttcggtcggatgaaccaaggggtccgatcatatccccgttttcattctggataaaactttttccaaactgaacagcctctttgcgggcatttacagaattacggatcgcattgtcaaaatttgccccgattccgtatcctacagcacattcaaaatgcagtttgtcggtgagaaattcattcagttcgcagaccttgttattgtgtgtaatatgctgcagcatttccacagtggtcagggcactgcagtgattatccactttctgagagatacaattcatcagattctttttaaagaaatcttccatacagacatagatctgctggatattttccggtgtgttatctgtcgaactacggggagatacattgatgataaccggaaggttggaacgcatgtgctccagctcgatcgtggacagaagttcatttgcaagatcccggatatggctgacacttggcagcggatagattgtcgggatcccgtgcgcacgaagctccggcaggatattactgtactgacagagaaccatatccatttcattgttgttccacatacggatcagctctgaaaggacatgattttcaattgtactgatgctagtgcgggtcagtgccttggtccagttgttaatatgtggtggaactgtatcaatgtccagctccttaaggaaagcggttgcagtacagccgccatcgatcggaatcaggaaatccagaataatccggtccatatccagatcccggttggaaatcagcagattcaaaagagcacggtacagaccggctatatcaatttcaaaggatacaatcggacggttataagcgtgcgcagttgactcaatggcagcttttgcgatcttaccactgataagaaatccgtcagtgtccccggcgtaagaatcgtaaacttctgatattgtgtcaaatttgttgtaggaaaccacctggatgtcgcagtttagttttagttctgagacgatctgcgagataggttcctttaagtactggctggtaatagccacaatttttcttctcattttctttcacctctcaaaaagtatcatataaaattatcttccataaatcaaccataatattctgaaaattaaaaaaataacgattaaataggtaaaaacaacgaaaatcaagaatattctgtaatattattgactaaaattttagaagttggtattatgtaatcgtgataactattctgtaaatgttcaaaaaactaataaaaatattctgtaaatattctaaaagtagaacagtatttttaatgtaaatggcaggaacaaagttaaaggagggcttagtatgaattactatgaaagagcattggaattaaaggatgaaacaattgcaaaccgcagacacatccacaaaaatgctgaaactggtctggatcttccaaagaccaaagcttatgttatggaaaagctgacagaatacggacttgagccgaaggattgtggctacggggtaacagctacactcggcaaagggggaaaggttcttcttctgagagcagatatggatgcacttccgatgccggaagaaagcggagaagaatttgcatgtcctacaggaaaagaagcacatacatgcggacatgatttccacgctgcaatgcttcttacagcagcaaagatgctgaaagaaaaagaagatacactggaaggaactatcaaattcatgttccagccggcagaagagacttttgaaggaagcaagaatatgatcgagaatggtattcttgagaatcctccggttgatgcagcacttgcataccatgtatcaccgggaaaaatgccaatcggactttttatgtacaatgataaggatacgatgatgtattctgtagatggatttaagatcaccatccatggaaaaggatcccatggtgcttatccacatgtaggagttgacccgatcaacatcggagttcatatccatcttgcattgcaggaactgatcgcaagagaaagtgatccgacacattcctgtgtacttacaatcggacagtttgcaggcggaactgcagcaaacatcattcctgagaccgctgttctccagggaacgatccgtaccaataagccggaagcaagagaacttttggtccgcagaatgaaagaagtcgctgaaaagacagcagctgtatataacggaaccgttgatattgagatgatctcagaagttcctccgctgatctgcaatccgaagcttaccgacgaagtggttggatatatgcaggagcttggaattccgggactcacaccatatccgggaatttctgcaagtgcttctgaagatttcgcagtgatcgctgaaaaggttccaagtacatttatgtatctgtcagcaggatatctggatgaaagaggacagtatccggcacatcatccgaaagcacagtttaatgaagatgtttgcccgatcggagcagcttgtcttgcccattgcgcttcacagtggcttaaaaataacaaatagagagtaaaggtttctttaggaacaggaggaaaagaatatgagtaaagaacagcaggctcaggcacagccacaggttgcgattccgcttccgaaggcaaagaaaaacttggttcagatcggatgtatctgcatgatgctttctgtagcaatgtatggactggtatttgcaacgttaacagcacctatccttgaaaaagttgatgcgatgggatatgtaggactcttctctatcgtaggtgcgatcggtgtatcgattatgactccgatcggaggaaaattaggtgaccttattggtagaagaaacattgtagtgattcctggaattatctgtgcacttgcaggttttgcatttgcatttgtgagatctctgattccactgatgatcctcagactgattgtcagtcttgcacagggcgcatttacagcagcaccatacattatcgcaggtcttatcaatgaaagaaaagatgtaccaaaggcaatgggtatgcttgcaaccgcaatcgctgttggtggatttggaggaagtatcatcgcaggtattttaacagatatgggattattgactgtggcaatccttatgccggcaattccacttattcttggtatagtactgatcggaatgaacatgccgaatcagaaaagagaaggaaaggttacgattgatgttccgggaatgatcgcactcatcgtatcactttgcggaattctgcttgcactgaactttggatcttctatgggatggacaaatccaatgattcttgcaggtcttgtaattggtatcattgctcttattgcacttgttaagattgaaaataaagctgcagagccgttgattccaatgaaattatttaaaaataaaaactacacagtactccttattgtaggatttatctgctatttctatcagaatgccatgaactattatgcaccgatcggtgccatgcaggttatgggagcatccacgagtgcagcaggtgcactgcagatgcctcgtacactgattacaatcattcttcctactatcgcaggtgcatgggtaggaaagaaagctgccaatgcatggaaagcaatggtaattggtacaagtcttgcaatgatcccgatggctgtgatggcgttggtaacaaattcaggtgcttcgatcatgatttattttgtagcacttgcagttacaggtattgctgaaagcttccgtgctgtatccattacgccaacagcacaggcaatgctggcaccggaagatatgggaatcggaacttctctggttaacttcgcaaactcactttcaggaacaattgcagttgcagtatttgcagtcgcatataatgcaagtacatcagctgatccgaccaatgtagcactgatccagaatggtgtaaaatctgtattctggacagcagcagtcgttactctgattggacttcttttggtaatcttcattgtaaaaccggagatgagcaagaaagcagcagaaagcaaatagaatattgaaatccatgtgaacatgtgaataagaagccggggcggatgtgaaaaagcatctgccccggttgttatctggagaagtcttttataaatctgccggatacagggatgagaatggaaatgacatatgtttcaggtaaatgcagattgcatttcagaaaatcaagagtataataagaaatagtgaaaagaagaaaggcagacatatatctgtctttttataattatagagacaattttaaagatataagaaataatttgatttaccggaggaaaagaatgcttggaaactatctggatgaagtacgaaaaaaagcaccactgatacacaatatcaccaattatgtgacgatcaatgatgtggcaaatatggttcttgcctgcggtgcaagtccgattatgtcggatgagccgactgatattgaagaaatcacatccatctgtcagggactgaatatcaatatgggaatgctgaatccgcgtaagattgaaagcatgcaaaaagcaggaaagaaatccaatgaactgtatcataaagtactgttagatccggttggagcaggatcgagttcgttccgaacagaggcggcactgaatctgatacgtgatattcagtttgatgtgatccggggaaatatttctgagatcaagaccttagcagcaggacatggtacaacgagtggtgtggatgcagacgaggcagatacactgacggagcagaatctggagaaaatgatttcgtttataaaggatttttccagaaggacaggttccgtgattgctgtgactggaggaatagaccttgtaagtgatgcaaagaggtgctttgtgatccggaacggtcgtccggagatgggacggatcaccggaaccgggtgtcagctttccgggatgatgacggcattccttgcggcgaatccggagaataatctggaagcagcggcagcagcggtctgtgccatggggcttgccggtgagactggctggaaatatatgcagccgggagatggaaacgcaacctaccgtaatcggatcatcgatgcgatttataatatggaaggaaaagaattggaagaaggtgcaaaatatgagattagataagaaagatatggttctgtatgcggtaacagaccgccactggctgaatggagaaagtctgtacagccaggtggaaaaagcgctgaaaggtggggctacatttatccagctcagggaaaaaaatctgggtgaggaagagttcctggcagaagcaaaagagattgccaggctctgtaaatcctaccatgtaccatttgtgatcaatgacaatgtagagattgcaaagaaggtagatgccgatggtgtgcatgtggggcagagcgatatggaagctcttgatgtgcggaaaacactgggtgaggacaagatcatcggtgttacggcaaagacggtcgagcaggcgctaaaggcacaggcacatggagccgattatctgggagtcggtgcagtctttggcacgacatcaaaggcagatgcaacaaagctggatcataaggttttaaaggaaatctgcgagacggtggacattccggttgtggcaattgggggaatcacggaagagaatgtgacagagcttgccggaaacggaatctgtggagttgccgtgatcagtgcagttttcggacagccggatattgagcaggctacaaaagaattaaaagagaaagtagagggtatgttgaaatgattttgtttactagcgattacacagaaggggcacatccgagaattatcgagaagcttgccgagaccaatatggagcagacagtaggatatggggaagatccatactgtgaagctgcaagagaagccatcaaaaaagtatgcgatgcaccagatgcagatgtgcattttctggtgggaggtacacagacgaactttacggtaatttcttctattttacgcccgttccagggagtgatctgtgcagatagcggacatatcaatgtccatgagacaggagcagtggaagcgactggccataaggttctggcacttccttcaaaggaaggaaaaatcacaggacagcagataaaggaatattacgacctgcactggagtgatgagtctcgtgaacatattgtacagccaaagatggtttatatttcacatccgacagaggtaggaacattgtatacaaagaatgaacttgaaaatatttctactgtatgtaaggaatgtggactttatcttttcctggatggggcaagaatgggttatgggctgatggcaccgggaaccgatgtgacacttccggatattgcaaagtgttgtgatgtattctatattggaggaacaaaggtcggtgcattgttcggagaagctgtggtaatcacaaatccatgtctaaagcaagattttcgttactgcattaaacaaaaaggtggaatgcttgcaaaaggaagactgcttggcgttcagttcctggagctttttaaagatggtctttattttgaaatctccaaacatgcgattgatatggcaatgcttttgaaagacggactgaaagaaaaaggatatgaattcttcatggacagcaataccaaccagcagttcattattgtggaagatgccaaattgcaggaaattcgtcaaaaatatggcgtaacttatcaggaaaggtacgatgagacccatagtgtgatccgattatgcacttcctgggcgacaaaagaggaaaatgtgaaggcattcctgcaagatatgtaatttgtgaaaaattgaataaagctttacaggtaaggcagatatggtaaatgataaggacttttttgcacagaaaatggcagaagagtccttttttgcttttcgtagtgttttaatatgagaaaataatagttaggcatttaattatttgtttgtgaaaaatattataaaaatataaattattgagaataaatgttgacttatgtgtgtgatacgcataaaataacgattagacttctaatgaatagatatctaatcaaattgcgggaggtgaaagggtgaagtcggataaatttgagtgtggggattttaccagggagaatatgccggtacaacttcttcttgcacaggtcggacatatgtataaatggtatgtgacgaaacagatgaaggatacagagctgaaagccggacaggcaggaattcttgcaatattgcagatggtaggaccgatgtcacagagagagcttgcagatcatattcatattacgccgccatcggtgaatgtagcagttcagaaactggaaaagctcggatatattagaaaagagcaggacgaaaaagaccagcggatgacaaggatccatctgacagaacgaggagagaagattcttggcaacatgcatgagattctccgaagcacggaagatacactcctgaagaatatgagcacagaagagaaaatactgtgcagaagactgcttttacagatgagtgacaatcttttccaggaaaaagaattccgtgatatgccatgtaaaaatccatttaaggaataaaaatagttactaagaaaggaaataattgctatatgagaaagttattcaaacatttgaagccttatgcagcaactatagcagcgattgttgttatcctgatcgttcaggcgtactgcgatctgtcattgccttcttatacttcagacattgtcaatgtcggaatccagcagggaggaattgatgagaagattccggatgcaatcgcagaggaagagatgaataagctgttgctttttgtggcagaagaagaccagcagacagtgctggatgcatatgagaaaaaggaatccgattcggattataagtatgatggagcaatttatgttctgaaggattccgtgaaaaaagatgaagaaaagtcaggaaaggtatttgacatccttggaaagccgatgcttctgacttatggatttgaatctggaagcgatacaacaaagaagatggaagaatctatgaaagaaaacatgatttcttctataaaggaacaggctgagaaacaggcagagagtatgcagtcccagatgacagatgagcagaaagcagcacttgcggcaaatccggagcttgccaagaaacagcaggatgaaatgcagaaaaacattgatgaacaggtgaaaaagatcgaaaatgcagatatctttgagatcctgaacatgataccggatgaacagagagcagacgttattgataaaatatcagaaaaaatggacgatatgccggataccatgctggaacaggaagcaacttcatatattaaagaaacctacagtgttctgggcgtgaatacagataagatccagaacagatatattttaacaactggcggtaagatgcttgcacttgcatttcttggaatgctcgcaagtgttaccgtaggacttcttgcttccagagtggcagcaagtacgggacgtgatctgagaggaaaggtatttaaaaaagttgttggattttccaatgcagaatttgacaagttttcaactgcatcactgatcacaagaagtaccaatgatatccagcagatccagatgcttgcagttatgcttctgagaatggttatgtatgcaccgatcatggcaattggaggtattttcaaggttctccatacgaatgtcagcatgtcatggatcatcgtacttggggtaatcctgatcgtgatggttgttgctgtattatttattgtggcaataccaaaatttaagattctgcagaacctggttgacagactgaaccttgttacccgtgagattcttaccggacttccggttatccgtgcattcagtacagaaaagcatgaagaagaacgatttgataaagcgaacagagatctgacaagaaccaatttatttgtaaaccgtgccatgacatttatgatgccgatgatgatgctgatcatgaacggaattaccatactgattgtatggagcggcgcacatggtgtcagtgacgggcagatgcaggttggtgatatgatggcatttatccagtatacaatgcagatcatcatgtccttccttatgatctgtatgatttctattatgcttccaagagcagctgttgcagcagaccgtgtggatgagatcctgacaagcaggacagcgatcgaagatccgaaaacaccggaaaaactggaagaatccagaaaaggcgaagtaaaatttgaccacgtatccttccgttatccgggagcagaagaagacgtacttcatgatatcagctttacagcaaaaccgggacagacaacggcgatcatcggaagtaccggtagtggtaaatctacgatgatcaacctgatcccaagattttatgatgtaacagaaggtacgatcacattggatggaaaagatattcgtaccatttcccagcatgatctgcgggatgaacttggatacgttccacagaaaggtgtacttttctcaggaacaatcgagtccaatattctgtatggcaatccggatggatccgaagccgagatgaaggaagccgcagaaatcgcacaggcaaccgaatttatcgaagaaaaacataaaaaatacgaaagtccgatcgcacagggcggttccaacgtatccggcggtcagaagcagcgtctttctatcgcacgtgcgattgcaaagaaaccaaaagtttatatttttgatgacagtttttcagcactggattataagacagacgtaacccttcgtgctgcattgaaagaaaagacacaggacagcacagtgatcattgtagcacagcgaatcagcaccattttacatgcggagcagatcattgtgctggatgatggaaagattgcgggaatcggaacacacaaagagcttctgaaatcctgtgatgcatattatcagattgcgtcatcgcagctttctgaagcagagcttgcgagagacttaaataatgaaaatgacggaaaggaggaagcatagtatgagtaatcagccaagaagaagaggacctatgggcggtggacatggaagaatgggaaccggcgagaaggcaaaagacttcaaaggtaccatgaagaaactttttacttaccttagtgaatataaaatcggtattttctttgttatgatatttgcaatcggaagtacggttttcaatattattggaccaaaggttctcggaaaagcgacgaccgaaattttcaaaggtctggtcggaaaagtatccggcggcagcggaattgattttacaaagattggtaaaatcctgttaactttattgtgtctgtacgtgatcagcgcatgtttctcctttatccagggatatatcatgacaggcgtatcacagaagctgacctatcgcatgcgaaaagaaatttctgaaaaaatcaatcgtatgccgatgaattattttgatacgactacacacggtgaggtactttccagagtaaccaatgacgtagatactctgagccagagcctgaaccagagtgcaacccagatgatcacatccgtgacaacgatcatcggtgtactgatcatgatgatcagtatcagtccgctgatgactgtgatcgcacttctgatcctgccggtatctatggtactgatttctgtaatcgtaaaacactcacagaaatacttcaaaagccagcaggaatatctgggacatatcaatggtcaggtagaagaagtatatggcggacataatattgtcaaagcattcaataaagaagaagacgtgatccgcgaatttgatgagactaatgatatcctgttccgttctgcatggaaatcacagttcctttccggaatgatgatgccgatcatgcagtttgtcggaaaccttggatatgtaggagtttctatcttaggtggttaccttgcaatcaaacagaccatcgaagttggagatatccagtcctttatccagtatgtaagatcctttacacagccaatccagcaggttgcacaggtagcaaacatgctccagtcgacagccgctgcatcagagagggtatttgaatttctggacgaaaaagaagaagatcagtttgctgaaaatccagtatctgtagaaggattacagggaaatgtagaatttgaacacgtacacttcggatacaatccggagcatatcatcatcaatgatttctctgcaaaagtaaaagaaggtcagaagatcgccatcgtaggaccgactggagccggaaagacaaccatgatcaaactgctgatgcgtttctatgatgtcaacagcggggcaatcaagatcgatggacacaacatcaaagacttcaaccggagcgaactcagacagatgtttggaatggtacttcaggatacctggctgttcagcggaagcatcgaagataacatcaaatacggcaaactcgatgcaacccacgaagaagtcgtagccgcagccaaagctgcccacgtacatcgtttcgtccagactcttccaagcggatacaacatgattctcaacgaagaagccagcaacgtatcccagggtcagaaacagctcctcacgatcgccagagccatcctggctgatccaaagattctgatcctagacgaagccaccagctccgtagacaccagaaccgaagtccagatccagaaagccatggataacctcatgaaaggcagaaccagcttcgtaatcgcccacagactctccaccatcagagatgcagatcttatactggtaatgaaagacggcgatattatcgaacaggggaaccatgaagaactacttgagaagaatgggttttatgcggaattgtataattcgcagtttgaaaacgctacaagctgtgcataaaaatggaaagatgccaaaaatcatgctcgcatgatttttggcatctttttatttttatatagagcgccagctctcattcggatgatgcgacagcattagccgaatgcagcacagcgtatgtgtcggggcaaaagagtagagtgcatcattccacaaactaatcaatctccagcggaacaggagcttcagctccgcttcccgcgcctgtcttgcgttccctaaatttaattcaattattttccaacatctctagcaacgccgaatttgttgatttatttatgatttctgtaattttcaatcaaccagattaaacgaatttgttgacttgtttttgagttttatagtatctagatcaataatagttccttatttcgttgattcattttcggcttttaagttttgcaatcatttttttcagtataacgcatgtaaaaatgtgtatcaatgaagcaaaaaataaatatgaaaaactgtaaaaaatattgccatcaataaaaatcatatatatgatatttataaagaacaaaggaggtttaaaataatgcctatgaaaaaaagattatccagttccattggtactattattgttctctgtgcgataatcataatatcgttgcagaaatatcagccggacaaagaagtaattactactttcatatatgaatggctaaatgacgattccagggcagagacagaatacaaaaaaattctggaaaccggaagtgataatcaatccttatctcagcctttgcaaaaatacttcataacagaagcggcattccaatctttcttaaagacattttattatttaccagtaaaaattctgcaacaatacgattcctacaatttaatagacattaacataacaaaagaatctaatagttactttgtaaaagtagacttagaattgataaaagaagaaaaatcaaagaatcattccatcacaataaaaattcaaatggatcataaaaagtttacctattttaccatcacagaaggaaaagaaatttaacacaaataagcggttaaaagataagaaacaaataggatataataacccatagatattcaggaagggaggaaatctttcatgcaaaaagtaatcagtatcggaaaacagaattttgtatctcttcgggagaatgattgtttttatattgataaaacagatctgatctgtaagtggtgggaatcaaaagatgaaattactttgatcaccagaccgcgtagatttggaaaaacattgaatatgagtatgctgaattgtttcttttccaatcaatttacaggacgggaagacctttttaaaggattggcagtctggaaaaaggaaaagtatcgtaaaatgcaaggaacctatccggtaatttttctgagttttgccgcaattaaaggcagtaattatgaagatgccagagatgggattatcatggcgatcaatgaagcctattcagaacataggtatctgcttgaaagtaatgaacttacggatggtgagaggaaatgctttgaagagttagattattatgcaaaaaatccaggaatcaaaaaacaggtggcaaatgatacaatctgtaatgcggtaaaaaatctggcaaattgcctgagccggtattataaaaagaaagttattattttgctggatgaatatgataccccgatgcaggaagcttatctctatggatattggaaagaatttacagcatttatcagaagtttatttaatgcaacgtttaagacaaatccatatttggaaagagcaatgatgacagggattacacgcgtgtcgaaagaatctgtattttcagatttaaataatcttaacgttgtaacaacgacatcaacggagtatgaaacctgtttcggattttcggaagaagaagtatttcaggtgttagaagagcgtgggatgaacaatcagaaaaagcttgtaaagtcctggtatgatggttttatatttggaaatacgcatgatatctataatccttggtcaattactaattttttagataaaaaacaggtccgtccttattgggcagataccagttcaaatagtatgattgatgaactgattcgaaaagcttccacagacatcaaagaaaagatggaagaattgctgcagggaaaagaaatcgtagttaattttgatgaacaaatcgtatttgagcagcttgatcaagatgagaatgcaatctggagcctgatgctggtaagtggttatctgaaagcagagcagatagaatatcggggcgttttgttagagccatggtatcatctgcgaatcaccaatctggaaacaacagcaatgtttacaactatgtttaaaggatggttcgcaaagaatcaatccaattataatcagttcatgaaggcattattaagtgatgatatagatgctatgaactattatatgaatcagattataatgacaacattcagttattttgatgtaggacaaaatgaaccggaacgattttatcatggatttgttctgggactcattgcggatcagactgatatctatgagattcggtcgaacagagaaagtggttttggacgttatgacgtgatgatgattcctaaaataaaagaaacaaaaaagtatccggcgattattatggaatttaaagtgagaaatataaaaagagaagagattcatcattatggttttgcatttgaaggaaaaaaagtattgataggataaaaagaagaaagtcaaactgctattgcgatttaaaactttttcatatagcagtttgactttatccgttttatagattaatgtaaataaaatcccagatccaatatacattccggaggcagatattctcgcggaatattcacaagtgcagtaattttccataagataccaaatccaatcagaatgagtagcattcctctgacacattttctataatctccggcaggaaacttatacaaatctttaattccaaaagcaaagataaaaattaaaatcaggacggttattccaaacaaaaagaaaaaagatttttgcttttctaaaatacgtctgttttcaccagactgttttttatgttccccttcctgatcgatggtgacttcatctccatcttttaatggatatgtagaccattttatgatctgcaaaagttgtcctttttcatctttttcttccggaagaagaatactatctgcggttatggaaagaggatcgacagcctttgaaaaggcgagaaattttgttccgaatactccttcttgctctgccagataaaaaatcatatttgtatcggtattatagcaacttttgggaatacggatggtagaattaagcttttcttcttctgtctgactgatcgttgcaatctctacaggtatctgcatccatttttctatacggatggataaaatagtacagatcattaaagaaatcaggatcatacatccggcattccaggttttctttttcatcattttatcaactccataaaatatcttttagtagccatgagcaaaactccacacattcagtatttatgcgggtttgcgaggcatggcaacctcattaatcacttcaaaagcagaaggcactttcggaattatgaaaaacgaccgttggtacaagagaattgtccgaagaggtattcattcagtcagtcgagtagactaagacctctcaatcttagcccctcacagatccgtacgtgcggctttcccgcatacggctcctcatagtaacattcgcttcaatataaacaatagtacgttttaggttttgctaacgggtaatacttgagcatttccacaaatccattccatgtgtatgcccgtctacaacctctccgattcatggctttgaatagaaactgttgtactctatgcaagaatgttgttatcttccgaaaattccatgtaacaccataataccgatagtgtccaattagttttacgttcaactctttaattatttctcgcattggtcgatttcgattatcgtaaatccagttcttgtatgctctaaccttttgctcaaacttcttccttgaagtctgtacctttggcacgaaacctccctttcgggttttgctacagtagaaggtaaatcccagaaaatcaaatgtttcaggcttacattctcctcttgctctacgattctgctctgcaaatctcccaaattcaatcagtctgcttttactactttccagctccagtccaaacttttccattcgttcctttaactctttatagtatctttcagcttctgacttatattgaaatcctgcaacaaaatcatccgcaaagttgacgtgaaaacactctccctgcatttccctttgcaccaccagcttaaaccacagcgtcagcacatgatgcatgtatatatttgcaagcatcggactcattactgagccttgtgccgaaccttcctctgttggctcgaattttccttgctccattattcctgctttaaggtatttacgtattagccacaataagttcttatcctgtatattccattcaagaaacttcatcatccaatcatggtcgatatggtcaaagaaacctttgatatcggcatctacgatatagctgatttttccatagcttatccgttggtatacttcttttattgcttcgtgacaccccctattcggtctgaatccatacatgcagtttaggaatctcggttcataaatagctcccagtattttcttcactgccatttgtacaatcttatcttcataggaagcaatccctaatggtcgtttctttccatttcctttaggtatatataccctcagtgacggaagtggcttaaaggatttgtttttcaacctctgtaccagttccttgatatttctatcaaggttcttcccatactcatccttagttaccttgtcaattccgactgctttgttcccatctaattccttatggcattgctttagcatatcttcatttatcaagtggtacactgatgtaaatataggatgttttgatgttgccgatatctcagctattcttactaatttcgtttccattatttcctccgtccctgagtacggataatgtgtcctcagtaagacctttactatgcaatccccttccctccatcggcattgcccgatttctacagtactatgggattgtccgaccacctaccattcatttgaaatcctccgttttcagttgcaacttcatactcttcttcgagaaatggcaggttctccccagttgatgtgtattcataatgtaaaacatgattggttctctgactccgcagtgccacataacactcgccatatcgcattatatgatattgtcttccgcaccagttaagacgtcgaccgactgaagttaacgtttcgaagctcaatcactattcaaccctgctttcttgctgtctacgcttgtcagatgccgttaccagcatcatcccaagactcgctattatctggttggctaaaccttggataaaccggaattccaccggcttgactacacacccttagctgggcgcacaactggaagttttactcgtggcgataggccacaatctatataaatatcagaaaaaaaagatgagaaacagaactgccgcatagattcaaaaaaagaatttctatggggtaggggaagtgcgctttctttgcgcatgatttcagtcatttatacacaacaggcacaaaaagggagatgtaaaaaaactcaatcgagttttttcacatccccattttttctcttccggggcgctctggattaccggttgtaactgttcttcgcccatttgtattgtgttcgacagagaggcggtgttaccctctgcgttgtccgtgttcgttctgacctgtacgggcggcacgcagcacgtgagaggcgagtacagatgttgtgacgtttcctactcctcccggaaccggtgtgatatgggatactttttcccggacattttcgtagtccacatctccacagagggttccatcttccagtacgttgattccgacatccgctaccaccgctccttcggcgatcatatcggcggtgatatggtttgcccgtccgatcgcagctactattatctctgcttcgcgacatctgtccgccagatcttttgtgcgtgaatggcagatagttacagttgcattctgtccaagcatcagcatggaaagcggttttccaacaaccatgcttcttccgatgacggtcactcttttcccctggagttcaattccatagtgattcataatgtgcatcactgcctcagaagtacaaggcgcataagcagttctgtcaccttcgaatatttttgcaagatttacaggactcattccatccatatcctttgccgggtcgatcatctgtctgatcttctctacatcgagctgctccggaagcggctggaacaaaagaatcccgtgaacctccggatctttattgatcttacagaaagcatcctcaaattcttcctgtgaaatatcttctggcagttctgcaatgcggcactcgattccgatcatttccattctcttttttgctccacgttcgtaggcaagatcattttcttttgctcctacccgaatgatcgtaaggcatggatttactcccgccgcattcaactcttctctttctctgatcagcttttctttcatggcttttgccacttcagcccctcgcatctgtatgctcatgtcttcctcctgtctgtcttatctgttatggtctgatacccttaagtacagcatcataagttgtctctttcagttctttgcctgtcgcaatcagttgatcagccagataattcagtctttcagcttcttcctgatccttcatcatctttgtattgataaaaatattaagagaagctccttcaagggctgcctgggcaaagaggattgcaactcctgcatcgctgactgcaagcctgcttcctttttcccccagcacctggatcatctccatagtatctacaattgttttcataatacacagtggtgcttctgccgcatttttaagtgcggcctccataactttttccttctctgcctgttcttcctctgtctcttttggcattctgtaagcctttgccagtggttcaaaagcctcggcatcttcatctaccatccggaccagatcctgcttcttctgctcaagtttttctcttatctctagaatctcttcttcaacatccgcatatttcttttttccgacagtcagatttgtaaccataagtcccaaagctgatgcgaacgctccgactgctgccgatgcaccgccacctcccggaatcggtgctgacgatgagagctgttccaaaaaatcagttgttttctgctccaataacatatttttcctcccgcttatttttgctttcctattatagcaaaggatttctcttctgaaacatagtactttctgatatgcctttcaggatatcggtatatgaaattctatctgaatcctaatgaaaatccggtgtccccaccatatcatacggggttgcctggtaaacatagtaattcagccagtttgcatacatacagttaccatgtgctctccatgtaagaagtggcttctgtgtgctgtcattgtctggataataattctccggcatttcaatcggaagtcctttgctcagatcccgcttatactcctgatccagtgtcacccggtcgtactccggatgtcccatcacaaaaatctgtcttccattctgtgccatgataaggtatgctcctgccttttccgactctgccagaatcatcagtctctcatctgcacggatcttctcaatcggcacatctgtatgtctcgaatgcggtgcataaaatacatcatcaaatccacgtaccagaggaatcttacggttcataaccttatgttcaaagataccgaaaagctttttgtccaactgtactttattaatcccataatgataataaagtgctgcctgtgctccccagcagagatggatcgttgaagtaacatgcgtctttgtccactccatgatctctacaagctcttcccagtaatccacctcttcaaaaggcatctgctctaccggtgctccagttatgataaatccgtcaaatttctgatcttttacattttcaaaattctcataaaaccggttcaggtgattcgctgaagtattctttgaaacatgatttttcactgccaagaatacaatgtcaacctgcagcggtgtattggaaagggagcgcagaagctgaagttctgtatcctctttcagtggcataagattcagaagtccgatcttgatcggacgaatgtcctgatgaaccgcacggttctcatccattacaaatatattttctttttccagtatttcttttaccggaaggtcattctgtacacgaattggcatttctgcttacttcctctcttttttattttccccgttttttaccgctgtatcattttcttccggattttctctgacaaatcttccgctatcatccacataactcttttccccatactccgaagtctgaagcggaagctttttcttctccagcaaatgattgatcagcattgtaataatataataaactactgcaaatgtaggcacgcccatgatcattcctacaaatccaaacagaccgcctccgagcaggattgaaaatacaacccagaatgcagataatccggtcgaattgcccaaaatcttcggtccgatcacatttccatcaagctgctgcagcacaagaatgaagatcaggaaatacaagcccttgatcggatcattcagcaaaatcagaacggcactcggaatagcaccgatatacggtccgaagaaaggaatgacattggtcacaccaacgattacactgatcaaaagtatgtacggcatcttcaggagcgtaagtccaaagaagcaaagcactccgataatcatagaatcaatgatctttccaataataaatccaccgaaaatctcattgcttttctttgtcagatgcaggatcatattggcatgatctgtacggaacactgcatagacgatctttttactctgtgcggaaaatgtttccttactgaacagaatatagactgatacaataagaccaatcagaaaattcaggatctcactgacaaaattgatgatcccaaccgtcaggtttgacatcacttcattaaccttggttaaaagatcctgtttgatccagttctgtaatgcatccgatcccttttctaacaggttacgtgccatgactccggcaggactggtatctttctggatacttatgatcttcgtaaccatatcactgatctgtcccggcagagtctgaaccatgtcacggatacttttataaagttccggaatcagcatattgcacagtgccaggatcaaagcaagcagcataaccagcgctgcaaaaacaccgacactacgcgaaaccttctttgccttttcctgagacattttcttttttaattgtggaatcagccaccggtcaatctgctttacgatcggattcagcaaatatgcgatcaccattccgtataggatcggctttaacacatcaattactttactgacacctactgatatatcatctattcggagtaacagaaaataaaagatcacacaagccgcaataacaaggaaaaaggtaatccccttcctgaaatgcagcaaaatctttgacggccctctgttgccaaattccggacgcttttcataatacgctgccgatttcttctcttccggcttccccgaaacccctttctctacattgtcttttttttccatttaatttccctgtctttcttcaaaagtccgatttttattataccttctttctaacacccccgtcaacctccccaaccatccttttcgcaccttttctctcattccttgcacacaaacaaacaggtgcaggagaaactctcccacacccatcactttcatctacgcacatccacaactgaaagttgcacattccgtctcatcacagctgcatgccttgctgccctccacactgatctttcctgcatggcactggcattccttattgtactggcactccgtggccttgcagtcgatcttgcttgtcggacccgcctcaccagtcacattgctgtaggtgccgctttttctttcttcaaagctgtcacagcttgtctctgcagctttccgtgcagattttcctcccaccgtaattgcgttcagatcacaataaaaatctttgttgtgcatacatgtctgtactgtacattttaattcaggcataatgttacctcctttttgaaaatcagtatcattatgcccgaaagttttatttcttattcagattttatttaaaactctatttatcgtcttctttttttacttcccttgctgttttggcctggatctccatcttgattgctgcaaggaagtccgtcagtgacttctgtccttcatccccttcaaagcggcttcttacagataccagtccgtcctcttcttcttttgctccgacaaccagcatatacgggatcttcttcatctgtgcttcacgtatcttgtatccgatcttctctgcacgtgtatcaatttctgcacgaacacctgaattgttcagttcatccagaaccttctgtgcataatccatatatttgtctgaaatcggaagcaccttaacctgtaccggtgcaagccatgtcgggaatgcccctgcaaaatgctcgatcaggataccgataaatctttcgatcgatccgaagattacacggtgaatcatgatcggacgatgtttctcaccatctgctcctgtgtattcaaggttaaatctgagcggaagctggaaatcaagctggatggttccacattgccatgttcttccgatagaatcttccagatggaagtcgatcttcggtccgtagaacgctccatctccttcatttactacatatggaagtcccagatcgtccaatgcgccacgaagggcttcagtagccatatcccaatcttcatcacttcccatgctgtcctccggtcttgtagaaagctccacatggtatttaaatccaaacaggctgtaaacttcattgatcagttttacaacgcctttgatctcatcacgtacctgctctggtgtcatgaagatatgtgcatcatcctgtgtaaagcatcttacacgcatcagtccatgaagctgtcctgatttttcatgacggtgaaccagtccgagttctcccatacgaagcggaaggtcacggtatgaacgtggttcagattcatatacaagaattcctcccgggcagttcattggtttgatagcgaaatcttcatcatcgatcacagttgtatacatattgtctttgtagtgatcccagtgtcctgatgtttcccagagatggcggcttaacataatcggtgttgaaatttcaacatagccggcttttttgtggatctctctccagtaatcaagcagctggttcttcagttccattccttttggaaggaagaatggaaatcccggtccttcttctctcatcatgaaaagtccaagttcttttccaagttttctatggtcacgcttctttgcttcttccatcatatgcagatattcttcaagctctgctttcttcggataggaagtaccataaactctctgaagcatcttattcttttcacttccgcgccagtaagctcctgcaagacttgtaagtttgaatgcttttaccggttttgtgctcatcaggtgaggtcctgcacaaagatctgtaaattctccctgtgaatagaagctgattacggaatcttccggaaggtcttcgatcagttccactttatatggttcatctttttctttaaaatatgcgattgcttccgctcttggcattgtatactgtttaattggaagatcttctttaacgattttcttcatctcagcttcgatcttttccaggtcttctgctacaagcggagtctcacggtcaatatcataatagaatccgtcttcaattgaaggtccgatcgcaagttttgtatccggatacagtctcttgattgcctgtgccataatgtgagatgttgtgtgacggaatgcaccttttcctttttcatcattgaatgtaagaatgttcagctcacagtctttgtcgatcacagttcttaaatcaacaacttctccgtcaacttctcctgctgttgcaacccttgcaagtccttcactgatatcttttgcaatatcaattacagacatgctctgtgcatattctttgcttgatccatcttttaatgtgattttcatagtctttttgttcctctctttattttataatttctgattatacaacatttttctgtgcaagctccggatccggatgttctcctgaccatcctgcctgtggcatagttgccagtctcgatacatcctcttcactgatctcaaaatggaacagatccatattctgtttcatccgctccatcgaagatgatttcggaagcggaatgatatcattctgaagcaggaatctcagacacagctgcgccggtgaaacctgatactttccggcaagttcaaggatcagtccatcttccagaatccgccgtcttccgatcgggctccatgcctgcatctgaataccatgctctttacaatactgcacagcagcctgctgcatataacctggatgcagttccagctggttgacaactggttttactgttccattctccagaatgttcttaatatggtgcggaagaaagttgctgagtccaagtccccggatttttccttctttctgaagtccttccatcgccctccaggtctcaagatctagttctttccagttctcacagtcagccgacggtcttggccagtggatcagatagatgtccagataatcggtaccaagtcttttcagactcttttctaatgcatcctttgtctgctgatatcccatttcatctttccacatcttggatacaaggaaaaaatcctttcttggaagattgctttcacggatcgcctgccctaaaaaatcttcggtctgataaaaggatgcagtatcaaaatagcgatatcctgcttctatggcagtctttaaaatctctacgttattcccttctgctgctttgtaagttccaaaaccaacgcatgggattttcatatcattgttcagcttgaaacaatcgtaaatactttccattagatcatcctttctgtaaaagctactgtctgtaattcaagaccgcatattgcacaaaagaatttcatccaattccattgcgcaagggcattccgatgaacctcttagaacgaaaatcgtgttcagcaatggcttccacgatttttgagtttcatctccattgcgcaaaaagtgaattggctgaatttcttttgtgcaatatgctccttcaaattttctagtacatcttttccagacaacttaacttttaaaataaaaaacctctgcaacagattatctgctgcagaggacgagtcactttgtatacccgcggttccaccccgcttgtcccgatttccaggacctctttgtggatgataacggtatccagccggactgttttacagccgctcggaggtggtcttcaaacgcttctgtaataagaggctctcagcctaagacctctctctctgggatttttctgcgttctactcttctcttcatcgcatttgctaacattataccatgggattttcatttgtcaacacgttcaaaaaaatgtattgaaaatttctatcagaacttatttgttcttaccacagcattttttatattttttaccgcttccgcacggacatggatcgtttggataaactttcttttctacgtggattgtacgtgcgtttttctgttctttgtaaaggacttttttcttttcttctgtaaaaatcttatcccactgtggcagttcatacagccagtcagcttttgcatctaccatgttcttgtaaagcagttctttatcaaaagcaagacttacctcagtgtcctcatccattgtttcaattggattagccactttcaggctgtcattaattccatcaaggaatcctgtcattgtaaatacattaatgccatatttttcagcaagttcctttacagttccttttacttcttcgtccggattctcaagcagcttttcatagatctctttttcagtctggaaataggttccccagaacttctgcagagaagctttatccatctctttcgagtaagcggtatctctccactgttctaataatgtactcatactgtaaattctcctttttgttctttatcacttcatatatcatacagcatttttcgactgtttgcaaaacattttcttgtagaaattgttttttatctatataatagagataaagtacagtacgaaggtggttgttatgaaaaaattcaagcgttttacagctcttatctgtgcaattcttctgttcctgatgtacgtcagcactctggtatttgcatttatcgacaaatccagatcattaggacttctgaaagcatctgttgcctgcacgattcttgtgccggttatgagttacgcctacatcctggtttatcgtctgatccacaggaatgatgacgactttcacagtgaatattaacatctcatacataaagctctgccatcatccaggcatggcttttctcttcgccgaatctgccaccgaatcgttttttctcctgttctctgattttctgtcttttatttagatattcttccatggaaatgacttcctgtgtgctgatattcttctctttctgcatatcttgttacctcctgtctacagttttttcgtctgtctgccttctggtataagcctcatccggcatttccccgacatctttaatatatgttcttattttctgatttatgactttttcttttttatgatgaatgttttattttaagagtatagccgtgttctgtgaccttactatggagattctctaaaaaaatcataagttgtttcttaagaaaatatgattgacaacaccacgtcaattcactaaactagacatagtgagtagtaagaaaggaagaacatcatgaacaatttgcagataccggagaattaccattctccacttacgatccgcgagactgaagtggctatcaaagaagtaaaagaccactttgaacgcgcacttgccaaatctctgcatctgacgcgtgtatccgctcctcttttcgtccgcccggaatccggactgaacgataacctgaacggagtagaacgcccggttgcatttggcatcaaagaacaggaagaccgcgaagttgagatcgtccactctcttgcaaaatggaaacgttacgccttaaagcgctacggctttcattcaggagaaggactttatactgatatgagcgctatccgccgagatgaagatactgacaacatccattccatctatgttgaccagtgggactgggaaaaagtaatttccaaagaagaacgcaacatggagacactggaatacactgtaggaaaagtatacagtgcactcaaagaaaccgaagcctacatggcacgccgttacaattatattgaagaattccttccggatgaaatcagcttcatcacatcccaggaactggaaaccatgtatcctgacaagacaccaaaggaacgtgaataccactttgccaaagccaaaggtgccgtattcatcaaacagatcggtaagacacttgcctccggacagcgtcatgacggacgtgcaccggactacgatgactgggaactgaacggtgatatcatcgtctactatccggtactcgatatcgcactggagctttcttccatgggtatccgtgtcgatgaagatgcactccgccgtcagttaaaggaagccggctgcgaagaacgcgccgagatggatttccagaaagcattactgaacggaaaacttccgtacacagtcggaggcggaatcggacaatcccgaatctgtatgttctatctccgcaaagcccacatcggagaagtccagtcctccatctggccggacgacgtcctcgaagaagccgcatcccgcggagtgtacttactgtaatacataaccaactattatcacaatttgataatttaccataaaaaagggcgtgtgaaaaaacgaaagttttttcatgcgtcctttttatatacaaaaacttactaaatttctgattatcttttcataagttggtaaatgacgatatatcccgtattttagggctttatcggtattttcttttcggaagataccttgcataagctggcatttaccagcatgaaaatgcaaccaaaagtagtaaatgagtagtaaatatacgctccgatattaacaagccagtctttccagttctgcttttgcagattgaaatgtaccgtgtgcataatagccaagtgtcatggttatgttggcgtgtcccatgagatattgcagggtgtttgggttcattcctctgtttgccatattcgtacaataagtatgtcggaatgaatgtggatgtgtcaagtataggacaaaaaaaatttcatttttcttactggaaagtacctgtctatttcaatcagatactccccagcacttttattatcttccacaaaatcgctcttgtccagagcattttatctctgtttcagaaatacatcatcaaaattccattcaatttcaatgttttcctggctatacacccggataaccttgatgatctcccgtaacttctctgtatcaaattttttcaaattcagaaattcttccaatttcattttcttcgcactatcgtcctgttcaagcatctttgcatcatgttcagactcttctaccattcgtctgatctcttcaagctgtcttcctatctgttctgctttctgcttatacacttcccggtcaatgcggtcatctttgtacgcatcgtaaagtttcaacttttcagaagacagctgtcggctctgtttcaacaattctgcgatattcgtccccttcgctttatcctgtttttttgattcaacagtatttcgtctttctaacatggacgttgcgaactgatgaacaagctccagtatattcttttccattagctcacgcctaatcaccaagcttctacaaacatgatcaccactggtacgcccatctgagcatttcatcaggtgttctgtttccctcaccagacaatgcccgcaatgtccacacaatatcaacgcaggctgttttttccgcctttccagggtataattcgttcttgtttctgcaacgcctctgttttttttcggatgcatcctattcgccttttcaaataattctctgccaataattgaagggtgatgattttctaatcgaatccattcctcttcattattcaggactgccttatgaccagtgtgcatactacagcgtgactttccccaaatcctggttccaatataaatttcatcccgtatgattgcagctactgtcgaagaactccagtgtttctttttgatcgtatcaaaccgtctaaactgtacctgatctcctcttgataatttttgttcatcacaggtagcaattccccgcctgttcagctctcttgtaatttcagcaaagctcgttccttcagccgccatctgaaaaatcatctttacaacctctgcagcatctggatcaatctcaagccttccatcttttccctttttatacccatatctggcatttaccggaagtcttgtgccattcttcatccttgtctgcatagcagatgaaattttttttgataaatccaggctgtacatattatataccagatttttcagtgctacattcataccacctgtcatcccactgcttgccgcactatcatagctgtcattaattgaaataaaccgtatctgaagaagtggaaaaatatattcaatataaaatccaacttccagatagtctcttccaaatcttgaaaaatctttcactactacacagccaatttttccgtctttcatatcttcctgcagctgttgaaaaccctggcgtttaaaatgtgtgccactgacaccatcatccacatattccaggatatcagtttcgtcaacacccagctgttcaatcacaaacgatttcaacaggattctctgagaagtcacactgtcactttccttttttgttctgccatctacattttcgtcttctatagataaacggatataaatagctatttttctattctctgtcatcttgactgtgcctccttctctttctttaattgctgcaactcggcaaactggtcatcatataccagcttgatttcatagtcatacttaccatggataataaccgaatccacaaaggcgtccaccatttctttcgtaagtttacgctttgacatataagtatgtattgtatctccccacccttcttcgatatgataatcttttgaatactgtacctgtgccgtcaatactgtatccagacggctcttgatgttctctatttcattggaataaatacgtgagaactgtaggtactcctcttctgtgatcaggcgttctgtataatcctcatataaatcagctttccgcttactaatacggctcagttccctccgaagctttcccacctctttatccaaaagttgatactttgtctgatttctggaagcggtattcatttcccgaatcattttttctgtatccagaactgttttcatatgcgcttgaatcagacgtagaacatcttcatccacatattcttttttgactctatgacctttgcactgatttcctcctgccttgtggttcgcattggcaccacagatataatagaaagtaccagatttttctcttgatagaatcatacggttgccacagcctccgcaccatatctttcctgtataataattctgatttcggatagagccattattcagctgatgcctgtttttgtatgattccgtaaactcccggattttttcctgtacctgttgaaataatgctttatctatgattccttcatgtgtattttccacatagatccattcactctccggacaatttctctgcttgttcccttgaaaaacactctgttggtattttccatatactgaatctcctgtacaatggatatcctgaagcacccgcttcacttcataattattccagggcttcgtctctgaaagcggtttttcccctgttttatgaaattctctctgcagaaccggggacaaaacgccatctttattgagttgttttgcaatatcactataactcaatccatccatatacatagcaaagatttttttcaaatgttcagcggcttctttatcaacaattaactgatgtctgtcctcttctgactttctgtaaccgtatggctcacaagcactggtgaattttccttctttccaaagtgctttttttgcacttctgctcttctttgcaagatctttggaataaaactcattgatgatattctttagtgggacagtcagatctactccttctctgaatgaatcaaaatcatctgtcactgccagaaaacgcacatgaaagaacggaaatactcgctcaatataattactcgtttctacataatttctgccgagcctggacaaatcctttacaatcacacagttaattttcccttgcttgatgtcttccatcatctgcataaatccaggacgctcaaaattcgtaccggaataatcagaatctttataaacatctgcaatggaaatatcttctgtatcggcaacaaaatttttcatcagttcaacctgcgtgtctattgttcccctctctctggtttcctctgtttccatagagattctggcatataaccctgcccggaatggtcttttcatttcttcctggatggctgcactgctgaccacttctgaaatgttttttctactttttcgtgccattttatacaacctcctttaccttgacctgtaaattgttattacaatccatcatggcatcaactcccatatccgggagctgtttcagtagtgcctgatagcaatcatcaaaatcaaagacaatctctatgttctttttatcatacaccttaatctcacgaatcagttctaccactactgtacgggacagtttctcaatatcctgatatttcacaaaataatccagccaggtattggaattatccgccttttcaagcattttatccatttccttctgtattacccggatattttcttccgcatttctaagtctttttccgtaggcagcgtgaagttcaacataatcttcctttgatacaattccttctttcatatccgaataaagcatcatgcgaagttccttacatcgttctgtctcctgctttttcttttccagcctgtcttgcaattttttcatattgatttcctgaaatggcacagtgcctataaactccaacactctttttagattcaaaatattcttaatatgctgtttcagcatcaccagtacggcatcttccaaatccttttccggtattctatggctggaacatcgctttgtttctttatttgtagaacataaataataagcatattttttccctgccacagtggaaacctttcttgtcattggtgctccacaatctgcacatactgcaattcctgacaacaaatatacctgtgttttatcaggggcagttcttgtatccattcccagaagtctctgaacaatttcaaaatcccggtcacttacaagtgcttcatgatttttttcaatccgaatccagtcttcttctggttttacataggactgctttactttatggttcggtgtcgttctttttccttgtacaaggtttccaatatacacttcgttttccagtattctgcggactgtaacagaactccaaagagcctgttctttctgccggaatccggtttcataatgactgccattgctgatcttatgctcaaatggagaaagtacgcccagttcatttaaacgattagcgattgcatcctgactcattccttgtaatttcatcttaaaaatatcctgtacaacactgccagctgatggatcaatctctaatttatgcttgtcttcctttttcttccggtatccaaatgccacgaatggagttacgcactcgcccttttttctctttatctcaagattactcctgatcttaatagaaatatcacgacaatatgcatcgttgattaagtttttaaatgggataataatttcatcagactgattttttcccttaagactatcataattgtcattgatggcaatgaaacgcacgccaagagccgggaataatctctcgatatacttcccggaatcaatatactcccttccaaatcgtgataaatcttttacaactacacagtctacagtaggctaagtacccagcgccttgccatattgctatggtaggtttccaaatactcgcccccgaaccgtacttacaactctcactgtatacggctctccatttataaactcaatttaactgtccacagtgtaatttcttatgacattctctacacaaagctattgttttgcgatttctcgctatcataagagcttcccaaaaagttttaccttgtaatccggaatggtcgctcccttatagaacagcttttctccgtccacctggcggtcacgcagttcataagacatatatttgtacatcttgtactgcaaaagctgctctaccagttcctgacgcggatcttcttcctcgccctcttcattgacttcctttggaagaagcatcttgcatttgatgtccagaagtgtcgccgccatgaccagaaattcactcatgacattcaggtctgctctgtccatcgcctggatatattccatatactggttggtgatctctacgatcggaatatcgtagatgtctattttatttttatcgatcaaatgtaagagcagatccagaggtccctcaaaaacctgcagctttaccggtattccttttcccatagatatcctttccagtcaaattgtcgataaccttatttattatacaggaaagccgggatgatatcaagtacgactaactctgccggattccagaagcggaaattgatcgtgtgggttccgagccctttgctgaccacaatatatttcccgtctttttcataacagtccccgctgtagcgtggaaacagacggaactgcggactgatcacaccgccaagcagtggaagtctggcaatcccgccatgtaaatgtccggacagcaccaggtctgctccccacttccagtaggtttctgcgtaaagcggatgatgtgccattaaaatgcagtatgcgtccgtctctgcactgccaatccgttcttccatctcgccagtcgtaagcggacacaccttccatccttttttatagcatccaaatggaagctccatcccatataagcgcagcttcatcccgtttaccgggatctcttctgatccattcaccaggacatgaatccctgcctttttcagttcattctcataatatccatattctttgccgtaaatctcctgctgctcatgcattctctgctcatgattgccattacagcaccagaccggtgcgatctgtggaaggtttttcatcaaatccgctgccgctgtccagtctcttccggctttcccgaccagcatatcgccgcctgccagtatcagatccggctttgcttccctgatcgccaaaagcagctcctcattctcttttccatagacatgattatgcagatcacttaagaaagcaatccgtacttttccggcatctccctttattttactggttctgatccggtatcttgtaatcttgaagcagtgcagctcccgccatacttctgcaagaactgctgctgcaaaaatcaccagtatcaatacgataatccctgttaccttcatctctttcctctttcgttataccatcatttcttccagaattttaaggaatgcgcccccaaatgtcaactccccgacaccttctgtcgcataaaccggaacgcttccgatggttttctcattcagccggtaaatgacttctccgatctggtcgcctttctttaccggggcagtctgtttctgtatctgtacctctttttccacggcagacagatctgatccactggtatccacataccggaagccctccagcgtctctccctttgccttctcctgcattccatgtttcacttcggcatacacaattttttccagtgccttttcatcctggtaaatactgcatttcccaaagccatagtttaacatggcaatggcatcctttatccgtgtcttagaatccggctctgccatcacaaccgcaatcatattgaccccgtcttttcttgccgttgcagacaggcagaacttcgcaccgcttgtggatccggtcttcagtccggttgcgtattcatactgccggatcagtttgttggtattactcagtccgaattcactgctgccctttgccgtagtgtgggtaatattttccatccagatcgttgagtagtcctcgatctgtggatacttcgtgatcagttcccgtgacatcagtgcaatatctctcgctgtcgtcagatgcccttccgtgtccagtccattacagttgacaaaatgggtattcgtcattccaagtcctgccgatctctgattcatcttttccacaaaagccggttcactcccggcaatcttttctgccatcgccacgcaggcatcattggcacttgccacagcaatgcacttgatcattgtatccacagtctgcttctcaccagcttccagaaatacctgagatccgcccatcgatgcagcatactcagaagttgtgacttcggtatccggcgtgatcgttccgtctgccagtgcatcaaagatcagaagcagcgtcataacctttgtcacactcgccgggggctttttctcatccgcatttttttctaagagaacctgacctccggaagcttccataataactgcggactcagcagatagttccagatcggtcagattgcccgaattgtctctgttcgtctgctccggatcctcctgccggatcacatcctgcatagctttcggtctttctcccggctcgaaaacatctgccgcccggaccgggatcccatatacggtctgcacgcacagaaccatgccaagcagacctgccagaaatttgcgcatcataagactccttttttccatccatcgatattatataaataagccttctgacaggaaaatagaacctttctttacacttcccggttcattttttcgccttcctcattgaaccagtccattgcctgacagattccttcttctgcaaatgggaattctctctttgtgatcttttcctgcggaatcttatcataaataaacggtccttcccagatacttccgacaagaatcgtttctgaattttcctcatcggtctttttttcttctttcgccaggcgatagttcatttttcccatacttccgttaaatttcgcttttttataaaaattcagcggaaaaagctgcattctttctaacatatttttcacctcaaaaaccggcacagaaactgggggatttctgtgccggtactctattttttatacaattatatcaataagtcggaggaatgtctatactatgcagtcttctgatctgcctcatattttgcagcagcttcgttgattgcatctctcatgatctcgattgcctgatctacgtgttcttttgcaaggatcagtggcgggatcatacggtttacgctgtcgccgatcgctgtgatcagaagtcttcttctgaagcatgcccattttacttcaagagcgatcggaatatcgtattcgcatcctaccaaaagtccttttcctcttgcttcttttacatgtggaagctctgcaagtttttctttcatgtattcacccattacttttgcatttccacttaaatctctgtcgaggatttcagaaatggaagcaagagatgcggcacatgcaagtggatgtccaccgtatgtagatccatgtgttcctgatgtaaatactgcagctacttcttcgcttgcgcagcatgcaccgatcggcattccgcctcccatagcttttgccatcgttacacagtcaggttttacaccatatcccatgaatgccattggagatcctgtacgtccccatccagtctgtacttcatcgagaaggagaagcatacctctttcatcacagagtttacgaagtccttcgataaattcctgtgttgccggatgtacaccaccttcgccctgtaccggctcgatcatgatcgcgatcgtgttatctgttacttttgacttgaaatcttcaaggttgttatattctgcgtaggagaatcccggaagcatcggtttgaatccaagctggcatgcgttatccggctgtcctgttgcggaaagtgctccgtatgttcttccgtggaaaccattgattgctgttacgatatggtaatgttccgggccatatttttcaacaccgtattttcttgccatcttgatcatacattcgttggcttctgttcctgagttctggaagaaaatcttatccattccgatcgtgtcacagatcttctttgcgagaagtgcctgtggaattgtgtatgggtaattgaatgtatgcatgatgtcatcaagctggtcttttactgctgcgacaaccttcggatttctgttacctggtgtatttacggcaactccgccataaaagtcgaggtaagctacccctttttcatcgtagagatacataccttctgcacgttctgcgataaaatcatatcttgcataggtttctaccatatatttttttacaatgtcctttaattcttctgctgtgagtcctgtgtctttgagtttcataagaatctcctcgctttccttcttttgatcatatactacttcatgctattcgttccggacttcgaataaaaatgtgtaaaagaatgtgccttttgtttagcaggaaatcccttcggaatttaccgctaaacaaaaagacgccatgtactaactgtacatgacgtccttgtcgtttacaagacacagtatagaccacagtctatggttttgtcaacaacaattatgtcaaaaaattatctttcattttgtcttttgcttgttcaatctgctgtatttgttcctcatccatgctttcctgaagattttctttcttctggcgataaattgtcgcggaaaaatccataatgtatccaatcaggatcagattgccaattgcacgccctgcacgaaccggtatcatggcaacaaacgctgcaactatgttctgcaggaacataaaaaggaacaacgtatagaatccccatgcgatcgaactctccagacagatgatccccctgtagttaaatggcttctcatggtaatcccaccagatctcaccgaaaatgcgcttcatcacaagtgccgtcagaaattccaatgtcgttgcaagaaacgatcccaggaaaaacagcagtatactattgtcgctatacggacgtaatataaaaaacaccgtaagagcaccaaacccgtagatcgggcaaaacggaccttttgcaaatcccctgttcgtaatcttatgattacaaaatgacatatagatggattccaccagccatcccatcatgctgtaagtcagaaaccacatcacaacctcatatccatctattccaaatattatcctattccaccacataaaattttcctgtaaaaatggagggtttatgaatcataaaccctccattattgttctgcacatattagttatatttacgttttctagcagcttcagatttctttttacgtctaacgcttggtttttcgtaatgttctcttttgcgaatctcctgctgaattcctgctttggcacagtttcttttgaatctgcgtaaagcactatctaacgtttcgttttctttaacgattacatttgacatagtctcacacctaacctcccctccagcctggtattgtgcatcatacgactgttcgggtatatttattgcactacattagattatatcatatttttcatctcagtcaagaattttttgaaaaataggaaaaatatgcataaatctgtcattttccggcattattttatctgttctgccagtacctctttgacttttgcaagggcatccgggattccagccgggttctttccgccagcctgtgccatgttcggacgtccaccgccgccaccacctacacaggaagcgattgccttgatcaggttgcctgcgtgagcacccttcttcattgcttcatctgttgctgtagccatcaggcttaccttgccgttcgcgctggatgcgatcacgaccacgccttctccgatcttctccttgagctggtctccaaggtcacgcagtccgttcatgtccatatcttctacgctgacagcaatcacttttacgccggctgcttcttctacctgatccatcacatcacccatggcatcttttgcgagcttgctcttcaggctttctacttcactgtgaagttctttgttctcagcctgaaggtgtgcgatcttctcagacacagtatccggagttgctttcaggagcttggctgcttcatgaagcaactgttccagttctccataataatccatcagtcctttggatgtaagtgcttcgatacggcgtacccctgctgccacaccactttcagacaggatcttgaatgctccgatctcgcttgtattggcaacatgtgtaccaccgcagaactcaatagagtaatctcccatatttacaacacggacgatgtcgccgtatttctcaccgaacagagcctgtgctccggtctttcttgcttcttcgatcggcatgttcttaatgacaaccggcagagatctagaaatgctttcatttaccatatcttctactttctgcagttcttccggtgtcattgccgagaaatgagagaaatcgaaacgaagtctcttgtcgtctacataagatccggactgttctacatgtgtaccaagtacggtacggagtgctttctgaagcaaatgggtcgcactgtggtttcttgcacaaagcacacgtctctgcgaatcaacggtcagagtaacctgatctccaaccttcatcataccctttgccatataaccgatatgaccgatcttgccaccaagcatcttcttcacatcttccacaacaaattcaccgtcaccgcatttgatcacaccgtggtcggcttcctgtccaccgcttgttgcgtagaacggagtctcatctacaaagatggttcctctctcaccgtcagaaagagcgtctacgatctcatcttctgtggtaagtaccgtaatcttcgattcatattccagatgctcgtatccgacaaacttagaagttacagacggatcaatggattcgtatacggttgcatctgctcccatgtagttcgttgccttacgtgcttttcttgcagtctggcgctgaacttccattgcagctttaaatccctcttcatcaatatctataccttcttcttccaggatctctttggtaagatcgatcgggaatccataggtatcatataatttgaacgcatcttctccggaaagagtctttgttccttcttctgccatcttttctttcatctcattcagaatgacaagcccctggtcgatggtcttctcaaactgctcttcttccttgcggatgacattcatgataaagtctttcttttcttccagctccggatatccgtctttagagccttcgatcacagttgcagcaagatctgtaaggaatcccggtgcaatgttcagaagtcttccgtgacggcatgcacggcggagaagacggcgaagaacatatcctcttccttcattagacggcataataccatcagagatcatgaaagatacagaacgcacatggtctgtgattacacgcagagatacgtctgtgctttcattatctccataagatactcctgcgatctcacatacctggtcacgcagtgcttttaaagtatcaatatcgaacatagagtctacatcctgtacgatacatgcaagtctctcaagtcccataccggtatcaatattcttctgcttcagttcgctgtagtttccatgtccatcattgtcgaactgtgaaaatacgttgttccagatctccatataacggtcacattcgcagcctactgtacatcccggtttaccgcatccgtatttttctccacggtcatagtaaatctctgaacacggaccgcacggacctgatccatgctcccagaagttgtcttcttttccgaaacggaaaattctctccggtgcaataccaatctcttcgttccagatcttccatgcctcatcatcgtcttcatatacggacgggtacagacgatccggatccagtccaaccacttctgtcaggaattcccatgaccagtggatcgcttctgtcttaaagtaatcaccgaatgagaagttaccaagcatttcaaagaaagtaccgtgacgtgcagtctttcctacgttctcgatatctcctgtacggatacatttctgacaggttgtcacacggcgtctcggtgggatctcctgtcctgtaaaatatggtttcagcggtgccattcctgaattgatcagcagaaggctgttatcattgtgcggcaccagcgaaaagcttttcatttttaaatgacctttgctctcaaaaaagtcaagaaacatgcgtctaagttcgttaactccgtaagctttcatctttatcctcctcgcttctatcagctaaattctaattataaagagattttgatggcttgtcaatataatggaatttaaaaaggaaccgcattttctgcgattccttcttttttccattctacttagtctctgaattctttgcgtcttttctttcgcgaagcttcttgcctgcaaaaacccctccgactgcaaacactccgataaagagcatcttcaataccgtagagatcagtgttgaaaaaaatgccatcttgtcatgcctcccatgctatcattttcttttctccttgatttatgcatattatagcatatacaaaaaaattttccaaacttttttagcattttcacatacaatttcgaccttttgtatctgccttgcagttcctactccaccatgccaaaaaatttctgcgcatagtgtacggactgcatggcatcttttccatagaaatctgccccgatcatatccgcgtaatcctggttcagaacagccccgcctaccatgactttgcagtccggttttttctctcttaagagtttgatcgtctcttccatgctgactacagttgtggtcatcagcgcacttaggcctaccaaagtgacattctcctcaactgctttttctacgattgcctccggcggcacatcctttccgagatcgatcacatcaaaaccataattttcaagaagaactttcactatattctttccgatatcatggatatcaccttttacggtagcaaggatgatcttctccttcttttcttcttcctgtccggatgaagcaagcacatccttgataaccgcaaaggcaatcttcgcagcatccgcactcatcagaagctgcggaaggaagacggttcccttttcaaaaccttcaccgactacattgagtgccgggatcagttcctcctggatgatatccagcggttccctcgtaccgatcaggtcacgggtgatatgatgcgcctcttctttcagccctctctcgatcgcatatttgagtgtcatctcaacgcctgcagcttttggtgcatttccggctgctgcagctgcctgcgatgcctggactgtcaccgtctctgtggttcccgcataagtactgatataattcgtacaattttcatcaaagcccatcagtgcattataagaacgataagctttcatcatatcttctgaagatggattgatgattcctgccgtcagtccgttctgcattgccatcgcatagaaatagctgttgacgatcgggcgccttggaagtccaaaagaaatattcgatactccaagaacggttctgaccccgaattcttcccgtactctcttcaatgcttccagggtaacctttgccccgtccttttccgaactgatggtcatggtcagcacatcgatcacgatatctttcttgtcgattccgtatttggctgcttcgttgatgatcttacctgcaacacgcacacggccttctgcatccttcggaatcccctcttcatcaatggtcagtccgacaaccacaccgccatatttccggatcagaggaaagacttcgtccatagaaacctgctttccgtttacagagttgatcatcggctttccattgtagatacgcattgcacgttccatagcctttccatctactgtgtcaatctgaagtggaagactggtcacgctctgcagttcttttacaactttttccatcatggcaacttcatcaatatccggaagtcctacattgacatccagaatgtgcgcgcccttatcctgctgcgtgatcgcttctttcagaatgtagtccatatcttcatttttcagtgcttctttgaattttttctttccggtcgggttgattctttctccgatgatacgcggcatatcatccaggatcacagcctgtccataagaagatacgatcgtatcatgctttttctcgatctcgcgcagcggaagatctttgcattcttctaccagctttttaatatgctccggtgtcgttccgcagcatccgccgatcacacaggctcctccttttacaacctcctgcatgatccgggcaaactcatccggctctacatcgtaatacgtttccccgttcttctgcttcggaagtccggcatttggcttcacaatgatcggaagggaggtatatcttcttaaatcgttcaggattggaagcatctgtttcggcccaagtccacagttcagccccagtgcatctacgcggagtccttccagcattgccacaacagaagggacatccccgcctgtcagaagctttcctctttcatcaaagatcatggttacaaataccggaagagaagaattttcttttgctgcaagaatggctgcctttacttcataggtgtcactcatggtctcgatatggatcaggtctgcaccgtacttttctccatagcggacggcttctgcaaatgcttcataagcatcatcaaaatccagatctcccattggttttaatagctttccggtcggtcccatatccagtgccacataagtctcttttccaatctgctctcctgctctttttgcatttgcaatccctgcgcggatcacttcttcaaccgtatatctgtcatcatgaaatttgcagacattagcgccaaaggtatttgcaagaaccacatcacttcctgcttcgtaatatctgcggtgaatcgcttccaccttttccggatgttcgatgttccaggtctccggaagttctcccggtgcaagtccttctgcctgcagaagagttcccattcctccatctaaaaataaaagttcttttcccaaacgttctctgatattcatgccctacgctccttaatttcttctgtaaatgcagtccttcttctcacacacttcgcagcctttgatgtggcatttttcctgcgtatcactgatcccaatgattgcagtcaccgattttgtcggtgtgagcatatagctgtctgtcatggtaagtccgatcttctttgccgtatccagcatccgtaagatatcgtcctgatgatggatatcaaaatcaccgtatcccggactaaatctcggtctgagccatttattctgtgcttttaactcttctccgatcgaaagctgcagatcgtcacagtactcctccagatatgcagctgcgcatgcctgcaatacaacagatttcgccatatctgtcagtgaataacgtttcatcagtatatcgacattggtaccgagtgttgcgccaaatacaactgcctctttgcagcctctgagattctttccgagacttctgcttttaatattcatttttccgatcgtcacctggtcttctcctgtaactttacagtcaaaaatgcgatagacggattttgcctgcgtagtctgatcgagctccccgaaggaaacatcgatcagcgcaagcgtctgttcatctaccgcatgtcttccatatcccagataacgaattgcttctttcgttctggcatctgtcatctttcttatgttcctttattttacgatttctgaaaggttctgcatgattgcagcagctacttccggtttattcatcgaatatacgtggatattgcggactccatttgcgatcaggtcaatgatctggtcggtcgcatatgcaattcccgcctgcttcatcgctgccggatcatctccaaaataatctacgatcgcacggaatctctgcggaacagcagttcctgaaagggcacagcttcttgcgagctgctttttcgttgtgatcggcatgattcccggaagcaccggtatcatgattccctgttcacggatacgatacaggaaattatagaaaatatcattattgaaaaacatctgtgtggtaataaaatccactccacaatctaccttttctttgagataacggatatcatctttcttgtgttccatctctacatgtccttccggatagcatgcagctccgatgcagaagtctcccatttttttgatgtcttcgatcagttcacaggcatgagaatactgtcccggaagcggaaactgtccatcctgcgggatatctcctctgagtgcaaggatattctcaatcccttctttctgaagctgtccgataaccttatgtacctcttccttggttgaggatacacaagtcagatgtgcaagtgccggaatcttcaggtcattcttgatatgacttgcaatcttaaccgtattcttactggttccaccaccggctccataggtaacactaataaatgacggggtaagctctgcgatcccatccgttgcttttaacacggattcaaagcccgcatccgtcttcggtggaaacacttcaaaggaaatatgtactccgtctgctttaattttgtctataatcctcataatgaatgtttctcctctgtaaattttttcatttcatgataccatattttccggtaaattaccagaatgcattttacatattttcgtaaagttcttcgtaaagcttggctgaattcttccatgagaagtctttttccataccacgctctacaatcttgttccagtcacgcttcttgtcatagtaaatctgttctgcatatcttacagttgcaagcatctcatgcgcattgtaattggtgaagctgaatccggttccggtcttctcgtattcgttgtaagcttctacagtatctttgagtccgcctgtctctcttacgatcggcaccgtaccatatctcagactcatcagctggctcagtccacatggttcaaataatgacggcatcaggaatgcatcacaggatgcatatatcttgtgagacatcggctctgaataatagatctgtgcagataccttatccggatacttccatgcgaaatgacggaacatgttctcgtatctctcatctccggtaccgagtacgacgatctgaaccgcatcctggcaaagttcatccatcacacagtcgatcaggtcaaagcccttctggtcagtcagtctggatacgataccgatcatcatacggtgcggatctctctccagtccgagttcttcctgcagcgccattttatttttcactttctccttgcggaagttttcgacagagtaagttcttgcaatgttggtatctgttgccggattaaaatcaccataatcaataccattgacaattcctgacaggcagtttgctcttgcctgcatcagtccttccagcttctccccgtaaaacggtgtcttgatctcttccgcgtaactgctgcttaccgttgtcacacggtcagcgtagacaattccgcctttcagatagttggcattgtcatatgcttccagcttatccggtgagaaatagtatgccggaagcccggtgatatccataaccgtcttcttatcccagataccctggaatttgaggttatgtatggtgatcacagtcttgattccacggaaaaactcattgttatagcggaaattatccagataaatcggaacaagcccggtctgccagtcatgacagtgaatgatatccggtctgaaatccagaagtggcagtgcacttaaggctgcttttgaaaagaatgcaaacttctcaatatcgtatgcaatatcaccatatggcttcgaaccattaaaataatattcattgtctatgaaataaaaagtgattccttcgtattgaagttcaagaagccctacatactgctgtctccagttcagatccatatagaaatgaagtctgtaagaaagtttatctttccattcgtctttcatgcacatatactttggaagcataacacgtacatcgtatttgttcttatcaaaatattttggtagtgatcccactacatcggctaatcctcctgttttgataaacggaactgattcagatgacacaaataatacttttttcatttaacaccctccttactctcgcggcttacttataattataccgcaatttcatccgtttgaaaagaattatctgcgctttgatttcagtctgatcgtgtctgcgaccagagcaataaattcagaattggtcggttttcctttcccgttacttactgtgtaaccgaaaagagcttctaaggtatccagctttcccctgctccatgcaacctcgattgcatggcggattgcccgttcaacacggctcgatgtggtctggttctttttcgcgactgtcggatacaggatctttgtgatcgcatttaaaacttccatatcgtcaaccgccatcagaatggaatccctcagataatgatacccttttatatgtgccgggattccgatttcatggagcagttctgtcacctgtgtttccaggtcctcctcagaaggttccgcatatacggtataatctgtgtaaggcgctacactcttttccgcatgtccggagcttttgatccgctgaaggattgtttcattgcgaaatggtttcaggatgtagtaggctgctcctttttcgaaggcatcttccgtgatcctctcctgtccaatcgcagttacaataataaaattcggctgtttctttactgttttatctgcgcctatcatttccatcacactgattccatccattttcggcatgatcaggtcaagaagtacaacgtcaggctgtttatctcttataatgtgataaatatcttctccgttcctggcttttcccaccagtttgagatctttatcactttctacaatttctcctagtaaattcaacattctttcgttatcgtcagcaatcgctacattcagtttttccataaagcctttcccctccttaaagtgacaatttgcactggaatgtaacctattataaccttctgtattctgtgaatacaagcaaatggtgtcgcagaaatctgacaaggttcgcatatttcaatcttttttcagattttccagcatgttttcgataaatattccgtatccttttgtcgcatcctgtacgaaaacatgtgtcactgcacctataatctttccattctgcatgatggggcttccactcattccctgcacaatcccaccggtcagtttaagtaaccgtttgtcagtaacctgaatttcaatccccttattcacctccctggcatccaggtcaacttttgtgattctgactgtataatcttctgtctttccgcttaccgcacagcggatatacgcctttccgacctgaatttcttcctttgccacagccggataagcttctttgctgtcaaatattctctcaatcctgtctaatttcccataaatccctgtctctgtgtttgtagtaatcgaacctaaaatattgtaatgattgtagacaatgatcccttccatccctccgggatttccgttctcaccttttttaatattctgaatgctggtatcatataatcttcccgttgacatttcgatcagtttgccggtatctacatcatgtattccatgtcccaacgcaccgtattcactatccgcattcagaaaagtgattgtgccgagtccctgcgcgttatcacgcacccagattccaagtttatatgccccgccttcatcttttgtcggatgaagttgtacatcaatatacactttttttcgacgaatgtgtaagatgacggacttattcgataattttttaacccgttcgataagctcagatttattataaatactgtcagaatcaactccgacaatataatctccctccttcaccagatgcttcgccggattcacaccgatcccatctttccccttaatttcctgcgtccccagcaccatcacgccatccgtctccatatagatcccaaccggcatccctcccggaatcagaaggtttcccgaaagttcactgaccgaagcctccctctccgctttcttggcccgccattccctgtagcaatagccgcctcctataaccacaattaccgctaataacacacttaacattttccgataacttctaaccgacattacacacccctttttcctccctaaaattccgcaaaaaataaggcaggattttttctcctgcctctagtatgtgctcaatcttattttttcaaaccggatgccagaattttcatctcccgtgcgttttccagcaccgcatccgtaatctttgcgcctccaaggatccttcccagctcctgcacagattcttccccgtcaagctgccggatcttggtctttgtcatctgatcttccacccgtttttcaatcaggtaatgagtatctgccattgcagcgatctgtgccagatgcgtaatgcagatcacctgatgtttcctgccgatcaggcacatcttctcggaaaccttctgtgcggtacgaccgctgatccccacatcgatttcatcaaagatcagtgtctcgatctcatctttatccgccatgactgccttgattgcaagcatgatgcgggaaagttcaccgccggatgccacagttgcaagcggtcttgtcggttcacccggattcatggagatcataaattccacctcatccgttccttctactgtgtacccggaggtttttgaaaaccgaatttcaaagcagacatccaggaaattcagatcctgaagtccttctgcgatctttgcctgcaaaagctttgcctcttttttacggatcttcgacagaccctcgcattctttttgcagacgttcctctgattttttcagttttccctttaattcatttaaatattcatcataattttttaaaatcaggaggcgctcctcgtcatccgccttatgctgcaggatcgcctctgccgaatctccgtatttgaccttcagatgattgatctggttcagccggctctccgtctcatagaactgttccggttcaaaggaaagactgtccagataacagcgaagctcgcgcccggaatccccgatcagattctccacttcgaccagctgttcatacagttctcccgatttgtcatcatattctgccgccacagctgccgcacgtactgcccgtccgatcgcttctgccgcacttataccgccttctcctgctgtatacagatacgcctcttccagattctctgcgattcttttcccctgcatcattcgccggtaatcttcttctacagactggcattctgccgcagtgattcctgcattttcaatctcatcaatctcaaattcaagaaaagaaatctctttggctctctcagcctcgtctttatcggcttccttaagttctttttccagccggcggtattccctgtatgaatccgccacttttttcttccattctccggcttcttttgcaaatgcatccagaattgccagatgattttttttatataacagtgactgatgctcatgctgtccgtgaatatcgatcagaacctgggctgcttcctttagccgccccagtgtcacagtctctccattgatccggctcacacttcggtttccgttaaaccgtctggtgataatgatctgccctccgtccggcgaaagatccatctcttccagcttccgtaccgtttccggattttccacataaaaggtcagttctacaagtcccttatcggctccgaggatcagccagctgtccatcggtgcaagggttgctcctgtcgtcttgatgataaaacgaagctgttcctgaatgtcctcgcggtttgttatcagaaaacctgcaagtgtgtcattatgtccacccagatattttgtcccgctatgcacaacaatgtcagcaccaagcttcagcggattctggaaatatggtgataaaaaggtattgtccacaatcagaagaagatcatgtttttttgctttctttgcaagctcttccagatcggatacacgcatcatcggattggtcggtgtctctgcataaattgcttttgtgttatcctggatataatcctctacatccacactgcttaaatccacgctggtaaatgtcagtccatttttcacattgatgctgtggaacagacggacgcttcctccataaagatcctcatcaatgatgatgtgatcgcccggtttgaaaatctccatcagagctgtgattgctgccattcctgtcgaaaatgccagtgcatcgatcccttcttccagcgatgctacgatcttctcaagatgttctctcgtcggattctgtaatctggaatagtcataaccacttcctccgcctactctgtctctcgcaaatgttgcagactgatagattggataactgattgccccatatatttcatccttattatcgtcagccagatgctgacatcgtgtatcaattccgtacttcattcttgtctatctctcctgtttctataaatcaatgtcgctatttactgtacaatatctttctaccaaaatccagttttcttttcataaatttacgcaagttctttctccgtcatcacacattcaaactctccggagccgcttacctgtgaaaaatctgcggtataaccgagcttttcatagaatccaagtgccgcttttctggaattgatatagatttttgtcacacctttttcgcgcatccaattttccgcctcaatgatccctgcctgtccgtaatgttttcccctataggattccagtgttgccacgcgctcaatttttccagtatgttcatccagataatgcagcctgcaggtggataccggataaattccgtccatcaccagaatatattcatcttccggtgtgtcatctgaaaattctccctcaagtgggatcttaaatcccaggcacattgcctgtgtccgcacatagtgtacgccggctctctgccattcttctgtcactctgactgctttcatcattcattccccgctttctttattttccggataatttttctcttccgtgtggtgtcagccataaggattcatccggtccatttggcacgatcgcaaattcattggacgggcagcaatcgatatgataatgtttcttgatcgccgcaaaattcgttgtgtcgccaaatcccggtgtctgatacaaatctcttgcatatgcccacagattcggataatcgcgaagaagctttttattcagacgaaataccggataatatgcacagtcaaatcgtaccagtgtcacataaagacgcacatcagattcagtcagtctgtcaccaaataagtatctctggtttgcaagcctttcttccagccagtccagacggttaaataccatattgtaagcacggtcataagccttctgttttcttgcaaatccagctttatagacaccattatttacctcacggaaaatgatatcattcagcttatcgatctcttctcttaaatcttccggataaagatccggtgctccctctttgtgataaggcttccatgccgtctcaaagtaaagtgtcaggttgaaataatcattatttaccaccttaccggacgggatatctacaagtgccggtacggtaaagcgtccggtataatccggatctgctgcaagatatgcctcactgatatagtggattccaagaaccggatccacatctccttcgtccagtgtaaatgcccagtcgcttctcggcacatccggtctcttcggatctgctgttccgagactgatcacatcttcaaggccaaggagctttcttacaatcacgctgcggtgcgcccacgggcataccggtgcccacaaaaggcgataacgccccggctctaccggaagcttaccttcgccctcgccaaacggtgtttcaaactgattcttctgacggttgaaatttccttcgctgtctacttctttatttacccattctatcgatgtattttctctcataatcttttccctttcctacgctgtctgattctgtttttcctgctcttgtctgatgcttcttggcgatacatatggctgtctctcataatcgttgtcaccaaaacgatagccttcttccagaagaaatccgatatcttccatccacttcagactttctgcatttccattgtaaatcgccatgcccgtcttctgtctgcggaatcccattttttcatacatggataccgtcttcggatgtgtatacaaaataacattacatccctttacctgttccagaagcgaatcaataagctttcgtcccagctgctgcccctgatatccttccagaagtgccacattgtagattgcagcctgacacacgccatcggaaattgccctcgcacagccaactacctggtctcaatcgtaaataaatgccgtcgcatagctgttcttaaatattttttcttctgtagcggcatcaaaatgactcagtccaaaatggtctaaaatatctgccactgcctgataatctacattttccttgtctgtcaccagtctgatactcattgctttcgctcccttcttttatcctgttggaaaaaatcgactgattcctcagccgattttgttttttctcttaaattgaataatccggttcttccatccggttaatctttgtaaagaactctttgacacgttcgttcttcggatttccaaacacttctctcggcgttccgtcttccaggatctttcctccgtccagaaagatcactctggttgcaacgtttcgtacaaagctcatctcatgggacaccagaagcattgtatatccttcatttgccgcttttttgatcgtatccagaacttctccgacaagctccggatccagtgcagatgtcggctcatccagaagtaaaagctttggctccatcgcaagtgctcttgcgattgcaaccctctgctgctgaccacctgacatatgtctcggataatggtttgcgtgatccagaagccctacatttttaagctgctttctcgcaatcctttctgcttcctcttttttcatcttctttaccacgatcagcccctccattacattctgaagcgctgtcttctttgaaaaaagattgaaattctgaaaaaccatgccggtctttttccgaagctctgtcagatctttgccatgaatatgtgcaagatcctgtgtctcaccgtcaatcgttacggttccggtttccggtttttccagtctgtccacacatcttaaaaatgtggattttcctgttccagaaggtccgatgatggctacgacatctccctgattgatggtaaggtcgatcccatcaagaaccttattatttttaaatgtttttgatatatttttgatttcgatcataccttattccacctctgtatctctgatatctaaaagtgccggtgcatcttccggtacccggagctttttctcaagatagctgatcactctctcaagtacgaaagtaattacccagtaaataattgccagtgagatatacacttcaaagtaacggtaatttcttcccgcaagaatctttccttctgcggtcatctccactacggaacagacaaatgcaagagaagttcctttgatcagtccgataaatgcatttccaagggatgggagtgctaccacgattgcctccggaaggatgatccttgtcaatgcctggaaataattcattcctaaagcgcttgctgcctcaacctgtcctttatctactgattcaagggaggcacggatgatctctgcgttaaatgcagattcattgagtgccagagcaacgaatgcatatacgattggtgcgactccattgacattgtagttggttccacatttaaagttgatatatttcaggagcatcggaataccgaaataggtcacatataactgaaccaggatcggcgttccgcggataaccgagatatagatacttaccagctgtttcagtaccggtacctttttaatcttcacaagtgcaaggagcagtcccaggatgagactggcgatcattgctgtgacagccagttccattgtgaccggaagatattttaaaagtagcggtatctgtgtaaataccagttttccatcaaataatttacccattagttaatcgtctcctcgaacttatcatcctccggtgcagtatcctgaccataccattttttactgatctcagtcagggttccgtcttccttcagctccttcagcgctttgtctacctgttctcttaaatctttctgatcctgtggaaaaatataatatgcataagagttttctgcaatcatttttgcttcatcttccggaatatcatttttctgcacatcatagttaaattcttccatgtaagagttgtacattgccagatcgatgatcgtaaaatcctgcgatccgtctgctacatgctgtaaaaatacagatgtatctgcatccgagtaagtaatattgatcgctttatccggattcttttcattccatgcttctactgcattggatacgctgattcccgtaccaccttcaaaagaaagtcctgctgcatcttcaaatgatttgatctcttttccacctttctttgttacaaatacatagctgatcttgtcatatggataagagtaaagataacttgctccacggtcttcgttgtaagagaagttgttgactccgatctgataatttccactgttcagtccggaaagcacagatccaaaatcagtcacttcgtattccagttcataatccggaagtttatcaaaaactgcattcagtacatccacatcgtatcctgccggcttgtcatcatcgcctatatagacatatggttttgcgtttgctccggttgctgctttgattactgtctttccactgtctgaagagctgtcctttgaagcgcttcctgaagaagatccgcatcctgtagccaggactcctgctgccagtgtaactgctaaaatgcttgccaactttttcataatatttttcctcgtctttcgtctgttatttttctgctttaaatttgtgtgccggatctttactgagtgattctcttcctgtcggtgtcttccaaatagtatcccagtctgtttcctgcaccacgatatcatagtatgtattttcccaatactcttcatctgcttcattcagatcgacagatgccgcaaaatccttaaaatatgtgttatgtctgaatgccgggatctgatacagatctcttgcatatccccacagattcgggtaatctaccagacggtgtttgcaaggtccgatatttcttgaataagacacatccagtcttgcgatggttgtataaagacggatatcactgtctgtcacataatctccgaataagaatctcttgtctgcaagtctttcctccattgcatcaagccctgcgaaaaatgtctcatatccatcggcaaatgcctgtaaggattcagcgaactgcgctcgataaacagcgttgtttacattttcaaagagccatttgttcagcttatcgatctccggtcttaattcttccgggtaaagatccggcgctccctttttgtggaacggcctgaacgctgtttccagatgatttgtaagccagtggtaatcattatttaccactttctttgtcttataatctacaaatgccggaacggttgtacgtcctgtgtattcttcatccgcattgtagtaaagctcacttaagaactgtgcgcccgtttccggattgatatgatccggggaatttacaaattcccatccaagattctcttcccggtctgtccagtctacgatctcaactttcactgcatcctcaagtccgagaagctctcttgcgatcgctacccgattggaccagttgcatccttttgcccagaaaagaatatatctgtctttttctaccggatttttcccttctccaaaaccttccgtgaagcggtttgactgacgatggaaatttccatattcatcaatttcctgtgcagtttctctcggtcttactctgatctgtcttccatttacatctacatattcaaaatctgccataattcgttcctcctactgttcttctgccttaaatttattgcccggatcgctgcttaaatgtgcacggtcatgcggtgcaccccagtatgcatcaaaattgatctcatccagaaatcttgcattgaaagattcaaaaaataatgcgccgaccttcttgttgtttggatttgcgaaatccttaaagtaggtgttgtttctgaatgccggaatctgatacaggtctcttgcatatccccacagattcggataatcgatcaggcggtgtttggtatgtccaagctgccaggtgtaacgaatatccagtctcgccagcgtcacatacagtctcacatcactgtctgtcacataatctccaaagagaaatctctgattttccagacgtttttccagaatatccattgctgcataaaaagaattataggcatcccagtaagcttcctttgatcttgcaaaggttgctttataaactccattattaatgttatcaaagagccagtcattcatctcatcgatatcttttctgagttcttccggataaagatccggtgctccttttttgtggaacggtttaaaatctacttcaaaataattggtaagccaggtgtaatcgttatttacaacttttcctgtctttgtatcgatcagagccggtaccgttgttcttcctgtgtaatcatcatcagctttgtaataagcttcacttaagaactggattccaaggaccggatcgatatgttctttgtcgtatacgaattcccatccaagattcttctcatgctttgcatgatcaaccatattgacactgattgcatcttccagtccaagaagttctcttacgatcgaagctctgttagaccagtggcaaagctttgcccataccagatggtatctgcctttttctaccggattttttccttctccaaatccttctgtaaaatgatttggctggcggacaaaatatccattctcatctatctccgatacaacttcctgcggacgtacacggatctttcttccatttactacttcataatcaaattctgccattatttcttcctccgttcatatttatcagtactggttattttgtataacctttatttcctatcaatttagttggtataatatcatctattacctactaagtcaataggttattttatttttttgtttttttcttgaaacacatataaccctacggtataataggtaaaaaagcaccagggttcataaactctctggtgctgctattgtacatataaaaaaatgggggaaaactaattatgatttctacaaaaggacgttacgcactccgcgtgatgattgatctcgcccagcataaggacgaagaatatgttccgcttaacgagatcgcaatccgccaggaaatttccgaaaaatacctggaaattgtcctgaaaattcttgtaaagaagaaactcttaaaaggacgccgtggcaaagggggcggataccagcttaccagggaaccttctgaatacactatcggcgagattcttgaacttgcggaaggcaatctcgctacagtcgcttgcctggttccaggtgccgaggtctgcagccgtgaagagcagtgcattacactccctttgtggaagaaatttgatggaatggtacatgatttcttctacgagattacattgaaagatgtgttaaacggaaatatttaaggagattttttatgaatacttcgaattttgaatggccagttgataaaaagccactgtattccctgctttcaatccgcctccgcggtctgattgacggaatccctcaccagatctcaaatctggcaaatgcatcggcccttctcggtgatgcgcttctgaacatcaactgggttggtttttatctgatgagagaaggcaggctcgtccttggtcctttccagggcaaacctgcctgtattgaaattgaaatcggtaaaggtgtctgcggaaccgctgtggcaaacgatcaggttatgctggtaaaggatgtccaccagttcccgggacatatcgcctgcgacagcgcctctaattccgagatcgtgattccgcttcataaaggaaatgaaatcgttggcgttctggatatcgacagccctgttctcgcccgttttgatgaagaagatcaggaagggctggaacactttgtcagaatcctggaatctatttttgacagataagctgttcttccagatagcttacaatcacctcagctgcatatccatgtgacttttcccccggatgccggagagaacccactttttcctccggcgtatccgggagttctaaaaatccataaatcttttcatagcgtgatggcacattatgatccggattattatcacatcctgacaaaactccccatcctctctgcgaaacagcccggaattctactattttccacacttgacattttccttttctgcttatacattattacattagcaaaactatttttatttggagagattaagatgaatgaattattaaaaaagatccgcctaaaagatgcttccgcatttacacatagtggaaaattccacgcagatgatgtattttcctctgcattgttattatatttaaatccggaaattacaatccttcgtggtaataaagtacccgaagactttgacggcatcatattcgacattgggcgcggcagatatgaccatcaccagaaagacagccgcatccgtgaaaatggcatcccttacgcggcattcggccttctctgggaagaacttggtaccgaaatcctgggggaagagcttgctgctaagtttgacgaagcttttgtccagccactggataataatgataataccggtgaaaaaaatgaactggcttcactgattggaagcttcaatccttcctgggacgaagatggcggaaccgatgaagcctttttccgtgcagtcagtgttgccggaatgatccttgacaataaatttgcccgttaccttggaaatgaacgtgctgacaagcggatcgaagaaattctcgaaacacaaaatcctgaagctgattcccgtattctggtccttcctgaattcattccatgccagaaacgtctttccgaaacagatatcgctttcgttatttttccatccaaccgcggtggttactgtatccagcctcagaaaaaagaatattccctgaattataaatgcagttttccatctgaatggctcggtctggaaaatgaagaactccagaaagaaaccggtctttcgagtgcttctttctgtcacaagggcggctttttgatgactacagctactttagaagatgcacgaaaagcatgtcagatcagtctggatacctttactgacgagattacccttgtaaatctcagttccgacacttctacagacacacttttaatgaaactgccagaactcacgcatgtaaaaattatccacaaacctctgcctgatctccctgctttagatatcaatggaatttatgctgaaatagaaatgaaaaaaacagagtggaaaaaatatatcaaagatctggtaaaagatctgctgaaaacgaaaccggaagctgtctatgtcgatggagatatgttttctatttacccggtcgtgcatcagcttcgcaaaaagcatatcccggttcttacttctgttacaaaaaacggtgaaaaacttattatccgtatcccatccggttcctgattttttattatcaggaatttgatgatctgaaagtgtcaaaaagaatgtgccataacacattctttttgacaaatgagagcttaattatcccagtataattttcgctttttatcatccagtccatccacaaaccttcttttaaatacaaggaattcttccagatccatcaggatatggtacagcatcgcacggctctcaaattcctctctggtctttggaagtgaattgttcctgataatcgcaaaaagttcatgtagttcatccaactgagctgtcggaactgtatgttccttcacacataccagcatatcaaacacataactcgaaatgatcattgcctcatctggcatatgcctgattttcttcatctcataatgtaagttatggatcacattgcactgcttcatacgcatttcaaaataatcgatatagtatcccggatgtgactgaaacgtattatcctgatattcataggcatcctggataaagccctgaacctctttttccaacgcacagatatcatcccatacatttctctgcatttccttattcgccagatatgccgaaatctctccaagtatcatctgcagacgttcttccgtatatcgcatattttcgaccaacgccttgcgctgacttccataatcataaaacaagttcaggaccagtgccatcgtaattccgatcaataccagcataaattcatttgcaataaaatcaaattcaaaatctctgacttccagaaaatgcattccgatcagtgcatttacagaaatcgtcgctccccatccaagcatctctgcgataataaccacaaaaaacacataaataccatatgccatccattctgattctactgccgagaatataataagtgccataagtactgaaattatgaatgttacaaccctcgctaccgataatttgacagttttccactttgtagtcaccatcgtaagaagtgcaacactccctgccgccagtgaatacttcagtccacacagattggctatgtaaatcgcaagactgcttcctatcgcaatttttagtgcctgcatcccgatctttttacttttcattgttcctcccgtgatctcatgcacatattcccatgaattctgtgcacttgattttatatccatatttatgataccgagaacaggataactatgtcaaatatttttttacttctatcctacctgatccactccaaaaataattttgaattgtattttcgatttttcattttcctgcagcttctccattattttcctgtgctaagcatcagtttctttgcaaacatcaatccatccttctgcatctgctgcatcatccagatcttcctgttgtttttgctgttgctttccatgcatgacaagtattttttcaataagctctggattatcttcaccatcaaccataccatcataaatcatgagtactttttcgtttttcacatcataatagtattgtgtatcattagctgtgttccttttttcgtctgccactttgatgcatacacagtcatatataatgcattcggaaccgactgatcatagctgaaccatacacatccatgtcacgctcatattgcaaatatccaaaacaccccctgtaatcattattataccgattaacagactaataaaccacctttttttatctttactctcctataatggtctcataaatttagacactttttcggacggattataatgaatctgatatactaaaatcagtatgaaagaaaggattcattgctatgtccagacaaaagaagaaattttagtgccaaatttaaatccgatcttgttctcgaatgctgaaaggagaaaaagatcttaatacgcttgcagttgaggacaacattcaacccaatcttctccacaattggaagaaagaatttttgaataatgcagccgttgtattgggagagacaaaatcggacatgattttagaagttttttgaaattattttttgaagtgcaaaaagacataaaaaatgccaggatttctcctgacaccatagcgactaaaccaatattcatgagctttcattttaccatctccccttgtttatttaaatatgcaacttttgatgaaatatacaaactgttaaggaaacaatcggagttggtgtaaacgaaaaagcagccttgagttctgataaaaactgccctttcgtttacctcaatttcgattttaccttggtgaacaaagtcgcgtccctttagccgatagctatggggattcaatcgttgctcttttccttaagtttatcataccggatgttttggtaaaagtttttttattcaagaaatcaatttcaggcatgacaaacaaacctcctatgcggaagtcatttattctatgcaattgtagatcttaacatctcatatgtgcacgaaaagaagaactgtatttatctttgcagggtgataccatattccctccgcaagaagaacatttgcatacatcgatgttatacaaaacctttatcatttctactgcatttagattttttaatgtagaaatgtatttcttacatccaagcaggtttctgcagtgagttatcttttttctcttgtttctacatgatagcagaccatagtgccggattctgacaaatcgtttgggaggaacatgcatcatgaatcgatggatgaattcttctcctgaaattgttttctctttccagcagctttcgtttttatagtcttttactacatatgtaactgtcgtatctgtcatggatttgattcgatgattactgattgctatcctgtgggtatattttccaagataattgataaccgactgtgcaccattgaaagtttctttacagtaagtgacccagttcttttcataacacttatcaagaagttctttaaaacgatagctgttctgatatttctctgctgtaccatgaaatttaagcttagaatcattccacaggctttttaactcatccagatattttccacggaacactttcgagataacaccatatgggagaaaaaattttccacctgtttctttccatttattttcatcatcaagcccacctccaagaacaatggtatgaatatgaggatgataattcattgcagaaccccaggtatgaagaatgcagatataccctatattagctcctagatactttacgtcttttgccaattcgttcaaggttgctgaggcagcatgatacagtgcatcatacaacagcttctggttgctgtaaatgatggaattcaattcctcaggaactgtgaatactacatgataatagggtgcatcaagtacgttctctttttgtgcatcaatccatttctctttcggaaactcctggcacatgggacagcatctgcttctgcaggagttattatgaatgctgatacatccgcagtcctcacaaacactgatgtttacaccaaaagcgcctgttttacagttcatgatatgataagctgtttttctatgatgagcaggagggctattcctcttttcataagaaagataaaaccgttcaaatacatcttgtatcgtacatgatttctccataatcattcaccgcccatctcatcaaatggactcctaattccaagcagagttttattgcttacatgcagataaacctctgttgattttggatcacgatgtcccagaagcgcttgaatatattttacatcacagccggattcaaacagatgacttgcaaagctgtgacgtaaacaatgcgtggagacatgtttctgaatgcctgctcttttggcactttcacgaaaaaactgaatgacacaatcttttgtaagataatcccctgtccatgaacttgggaacaaaatccctcttggtctgccacattgaaaccagtattctgtcaatatctcgagcgtccggtctgcaagcaaagtataacgatcagagcgacttttcccatcacggatgtgtatggttttgttcgtgcgtgaaatatcatcataatgaagatgtgtgacttctgaaacacgaagtccgcctgaatacatagtagcaatcatagctttgtgcttcagatttggcgtagcatcaagaatagctgatatttctgtttttgtaagcaccgttggtaacttcctgtcccttttcatacgaggtatgtcatcatcatcccaattcttcttcaatatttttttgtaaaagaagcggattcctgaatggtagtgattgtatgtttccggtgaaatcccggaaagtttcttttcagttaggaatatatcaacatcgtcagttgttaatgcatctatatccttggctgtgtggttcaaaaaatgagcaacactggtacagtatgcatgaatcgtggaatccttgagattccgtttattcgcagcagattgaatttgattaaaaatttcttcgtacataataaaatcctccatgtaaaatcagtagttaatgaaaaaaactgcttacatggaggtgcattagcataataaaaccgcttgtcagaaaagcggtcaaatggtattcttttcataggcagtggtgtctttctgtattgaactgttttgtgtggtaactttacaatatcaaatactggtaagaattgccattgcctattttattattgagaaaaggaaagctgcgccacagccttggcaggccatcgcgcagcgattttgttcaacttgaagttagcgatttctttttccggtattctctgtcccacggatttcctcatgatagaaataatctacgatcaccggatgcccctgcgggactctgccataaggcatttcattatccacaaaggcacaatcatacttcttagccattttctcagcttttacttcaagtgcttcaaagtagctgcggttatgcttgttatagatctcgtcgtaaagtggtacaagatcaggatattttccggcgatataatccataattgtctttttgaaaccgcctcgaagattgagattttcgagccagaacagatcgcactgatcctttacccgctcaaagattgcttcaaaatccgtgataccggggaataccggggatacgaaacagactgtacggatacctgcctcatatacctgcttcatagcagcgatacggtgctcaatgctcgaagcagagtccatatcgttcttgaaattttcatctaatgtgttgatcgaccatgaaacggttacacgtccaagcttcttcagcagatcaatatcccgtaccacaagatccgactttgtgcagatcagaatatctgcgtcactgccgatcagctgctccagaagttttctggtattcccgaattgctcctcctgtggattgtagccatctgtcacagaaccgatgaccacccgctgtccggcatatttcttcggatttttaatttccggccaatgcttcacatcaaggaaagtgccccattcctccttgtgcccggtaaagcgcttcataaaagaagcatagcaatacttgcaggcatgtgtacagcccacatagggattgaccgagtaaccgcctaccggcagactagacttagtcatgatgttctttgtttccacctcacgaatgaggattccattcattacttcttccatgatttctgcacctctaacactttattaaattcttccggcatttcctgaatcatattttcatcccctatgatagagacaaggtcttccttcataaacaccggaatgccgagcttatgtgcctggtccgtcagagaccatgcccattccggcttccatccggagagatcgctcatgccggtaagaagaaagttctgcggacgtttcttttccatcatcttgagcttacccggaaagaattcagggtcagcgaagtcatcaatcatatgccagcgtttcacgttgttgcgggcatagcaataggcacaccccactgtgcagccaatgacaatattcatgttctgaatctgatctttgatacaaatactcatgacttctgccactcctcaagattctttctgatgcggtcgaggcattcctcaaaccgggtaatttcttcctctgaaaaaccttggtagtaaatactgcccatctcatcagatacagaatcgtactcgccctttaaggcatgtgctttctcagtcagaagcaggagtgttttccttttgtccgtttcagactgaacacggcttatcagcccttgattttccattctttccagcatcgtagtaagagatgttatcgctaatccgcatttagtcgagagtgacctgattgagataccatcctcctgccacagcacataaagaatacgtccctgggctccattaaacgcatcaatattcttttcactgagaatcttctcgaaaatccggtctccaagctgttttattttggtgacaagaaatcctccattcatttccatacaaaagctcctatatagtagtttattaaaaacatactatataggagctttattgtcaacagtttatatgtcctaatagataaattccgttttttttaattctccaaacttgaattgttcaagcttttcaaatactaacgtccttaattctgttcaataattgatttatagtagttaccaaagtcagcagaagctgctttatgcacatctcctgccctgtcagattggtttatcctgtaatttttattttatttttcttctgtttcttttttgttgtctgtcatttttgacttctttctgcggtatacagtcactcctgtagctgttccagcagatgccagtgcaagcagaacaaacgcccatattttctggttatcacctgtttttggtgcatttgttttttctgttgttttctccggtgttctggcatctttcatttctactttctggacttccattgtatctttcaatgtaaatgtgacatcttccgcaatctcgtaaccatccggtgctgtgatctcacgcagagtaagttcttcattgactgggagtttttcaacggaatgtggttttccatctgtaatccactcttccagaacagttccgtctttgcggataatctgaagctttgccccttccagttcttttccggttgtaaggtctgtttttgaaatttccactttggaatattcatctttcatctcaacctttgtcacactgccatcttctttgacttcaaacatcacatcgctggcagacacatagccatcttcataaggagccagttcctcatgtaaggtataacttccttccggcagtccgtaaatgacatgttcttccttactgcttacccattcttccacaacatttccgtctttatcaatgacctgcagtttggctccttccagctcatttccggtagttgcatctgtttttgtaatgcgtgtttctgtcggctgattctcaacttctttgttcagttcaatctttgcaagattctgattttcgtaagttgcatctacattccatacttcctcatttggaagatatccagcttttctgacttcctctttgacatagtattttccatgtggaagatcactgtcgaaagtaagtgttccctttgcatccgttgctttcttttccagcaaggtatctttctctacgagaacctctccctgattagaaagaatatcttctgcagcatacagtccaaaaataacaccttccagcttttcgcctgtgacagaatctttcttttctactgatacgaaaactttctgtctttcatttttataggtaacgccttcataaacaactgcctgtgtatcatcctctgctgtcagggtaaattctttctgttctgtatttaggacaaaattctctcctgctacaacttctttcagataatacgttcccagtggcagattgttgataactgctgttccattttcatctgtagtcagtttggctaccagatcatctttctcataacgaacaactggatttccttcttcgtcctttgctccgtccggtgaatagatggtatctttggcatatacttcgaattcagcaccttctactccggtttcttcatatttaaagcctttataaatacctgtttcttctttaccagatacggtatttcttactttagaaaccagtgcttttacttttgccagaacagaatctccggttacttcggtaagctgttctccctttttcgtcaggagcaggcttcctacctgttcgtcatttttctgttctacttctacaatcgcagctcctgtatccggatcaatctgatgtgcagtgtttgaggatactgtaattacaataccattctgtggattttctttatatgttccttttgtagtctgctctaatggtgaaataatcgttgttccatcatacagggactcttcgcttccctgtcttacaaatccttccggtgcttttacttcttcgattcgataggtagcgcacttcagttcctgcggtgtgatcagatatccttcctcatttgttttgaatacactgatcttttctttcttcggatactgaacaacctgttccacatatttcttatttgtcacatcgtaaatcttataagaggctccggcctttaaaaccgtatttccagtctgtgcatccttctttacgattttcaacaaaaattcaaacggacggtcatcaaatactctccactgcattggttctctgctgtcattttccacatttacaacaaatggatcaatggttttcagattctccggggtagtgctttccactacaacataacttccatacggcagttccgggctgactgcatatcctttggtatcagtgatcagttccggtactggtacggcggttccattctcataagtaactgcaacctgctctttgctgaagtcataattcttgaaatcacttgctgtatagctttctccattggacggtttcagtttcccatttttcacctgtgtcaggtcgctgatcagatataccttaaatcttgctcctgcaaccaggtccgtttctgtctgctctccatcttcactgattttgattaactggaatgcctgtttctttacctgctcttttaccgtaaggtctcttgtcacttcggcaacatcctgaccttcataagttactgatacctcatatttggtagtatccagtgtatatccttccggtggagtgatttcttttagatacatttctccaaggtataattctgaaaattccagtgttccgtcatctccgatgactccctgtgcaatcaggctgtcctgtttatacagaactcctgttgtgccatccggatgcacgatgtcctctttggcataaagaccatacaccgcaccacgaagagcactgtccccctgcgctttaaatgcaagtgtttctttatcgatctttgcgatttttacttttccggtgactctctcatctgttgctgttacattcaatgtctttccggctgcaacatctactttatatacttctgtattcagtttatatcctgtcggagcagtgatctcttttacatacacagttttcagtgcagaatcaaaataatcgctgactgcttttccatctcttccggttgctgacattgtcatcagcaggttttcacacttcttatcagtataaataccataaactgctcctgacagtagattctgtgtattgacatctttcttcataagttcaatgcgtgtcatattcagccactgtacactaaaacttaccggagctgctgtttcactttcaaatacaccgatatcctgcttggaatttccggttgtcagcaccagtgttctccatgtctttccgacagaaccatataagttgccggaagcataactgcctgtcagtaataaatccgcagacagatagaatgtatctccaccataaatctggatttttccatttgtaacacttgttcctttggaaagattatgtgctgtcacattttccggtacactcaatgtcacatagtttctgtgatctccagacagtgtgatatttggtgttttctggatgtttccatcccgtactgcattcagctttgtgcttgaaaggctcagttcaccttttggcggttcttcctgtccaaacagataattgatatatgcgataacccctgcatttacaaggtcattataattacaccctgtaaatccggcttctcctgcataagcgtagctggctgcaatgtgtgtatacacatacttttcatcttccgtttttccagacagataacttcctgtcagatctcctgccccgccataaccataataaaggactttctgtagatttttattgctgtccagtacctgtgctacataacttccactcggtggggatgctttctgggactgaaggcagtatgcaattttcccattgactgtaaacaggcaagtaagataatttccaatataacttggataataaatagttctcccctttgtcaatgtaactgtggaaccgctgcttgtagctctttcagccgcagacaataccatcacatttccctcttcgatgtcctctttcagttctttgactgcctgtgcagatgcatcttcttcggatgtttcaatttctacatctgtgtagttctgcacaggcgaatccgaatcatcttcagattctgtatctgacttctgtttctctccaccattttcttcagaatgtgcctgaccttctgtatccgtcagagtcactttccgggtgatggtatagctgtcactcttatcttttggaacgaccatataagtggcaatatatgttcctgctttgtcagaatgatactctccaccattctcatctttgatacttacaagcgtaacatcttctttttctgcatcataatggattccttccatacaggtttccaccgcaaatgtttcatccgaaaccgcttttgtgatatcatctgctgtaaccgatgtatctttctggcttgttaccgcctgtacttccgtctgctgttccgagcctgtctgttcgaccgcaaacgcatttacactgctcaaggtactgatgcccatcaggacagccagtccaaaagcagctattctggtctttaattttctaaccttcatgtgcttttccttcctaattataaatagatttttttaattaaataccgcagaagatgtttcctctgcggtacgttttatcttgtatatcgatttttttcttttttcacttcctgtctggtacgcttcaccgctttcatgacagaatctgttggaatctggttatccttatatccttccagaattccatccagataaaacttcgatggtcttgccggaacatctttgtgcggagcgttcatcatatatacaaacacctctttctccactccatcctgattttttacctgaatcgattctttcccataaaaacttgggaatccttcatagaaatccagactcttctcacacgcttctgtgattttccataaaactccttcgacacagcttcccttttccggcagtaccgttgctactccgttacccggagcctttcctcgaaatgccagccgataatcttcaagccggacattttccacaacttccgcagccggacacctgtacttcatctgctccagattcatgttgctgccataagcgaagtaatatctatcttccattttttctcacctctatctgactccttctgtcctttgatttttcttcaaacactcatacgtgcttttatcatatctccacgcaagatcaccatccagatttgccagcaaatgttttcggacatttttatattcgtctccaattaacccaagtctcaataaaaatgtacgaaatgtaaatgctggattttctgatatcagtgtctttttcatctgtgtcgatctctgattgatcgcctgtgcggaaatggctaatgccagagtaatatttgctcttacctttcctgcatgaagtgtgctttcaaaacagcgccattccaaagttccttttgaaaacacagcatgaagattcagagcataataacgggtatgatcataatgggtatgacttccatccctgcctccataccagacatttcttactcggtccattgtgattgatttatttggtatttttcggattttctccaatacctccggtcgcaccctctgacaataactatttgctcttctctcctgcactttcagtgctttgaacagaatatcttcctttgcatacataattgtcagtgcatttttcagactctgcggtgtatgattcgatgcatctacatgaacatgctgaccacaggactcatttacaaaaccgccatgctgtcgcagacatcgtactacttcctgtaacttacccatttcatcataggataatttcggagataccatttctgttgaatattctccacctgcgtctacaattcgaccgtatacttttcgttgtgtataaatgctcccatcagacataaatttccacttttttccttccaaatctatcactgaccagactccataagtagtgccgtcataatatgcttctgttccaaacatttcagcaacaacttctgcagcacgttgtctggtaattcctgtcatctcgatttctgtgccaaagtattggtcttttataccgatcatgcctaatggattcctttctcagacacttcctgtgtgttgagttcggagtctgccttttgtaacaatctgccaattgcctcgataacattgacagttactccgtttccagcctgtttataaagctgtgcatcagaagtgctgtctatgattttatttatttgccaatcataatacccctgcagtcgcagacattcccttggaactaatcttcttattcttccgtgatacaagatgccatgacgatcggttgcagtaattgtaaacatcggttcttctggttctttcatgcgtctgccgttctgacggacattttctttggctggtgtaaggactgctcttgccccttcttcacttaatacgccggaacattctcctttgtatttatggattccacattgtcgggtattaaggcttctgcattcttcagttaccagtggtggcggagacaaatctacaaaatgaagtgttccctgttggatacctgtagtcagggtgtgtgctatctgatgtccgactcttcctctcctgctgttgagattcgcatagcctaaatcgatgctgtcaccctctcttgcaagtttgtagccgagctttgtattttctttaattggaacacccacatcatataatcctgtctttccacccattcctccggcttgtgatgtcagggtacagcttaatccttttggactgtagactctttttccctgacttcctgcccggatttgaacaagagctgctccatttgtttctggttcaggtaatacttttccggcacatcggaaatcaagatatccgacaatatacacccgctttcttgcttgggggactccgaaatccttgctgttaagcactttccattcgacatgataccccagttcagaaagcgtactgaggatggtgcaaaacgtccggcctttgtcatgcgataacaaaccgggaacattttcaaggataaaatacgatggtcttttagcttcaagaatccgggcaatttcaaaaaagagagttcctcttgcgtcagcaaatccttctcgctttccggcgatagagaatgcctggcaaggaaatcctgcacagagtaaatcaaaatctggcattcgttctggttcaattgttcttgcatcactacaataccactccccttctgtgtcaaacagcaatcggtagttcttatccgcataagtatccacctcgcaatgtccgacacagacaaagtttcctgcccgtcttaagccttcacggaatcccccgattccgctaaagagatcaaaaaattgaatggttgcggctatcaacctcctttttgctgataaaaacaggcggcatgatttctcataccgcccttcgttattctgtatcaattggttaccattctgttggttcttctgttttggtttcttcttccagatcagtttctctttctggttcagtttcctcttccggttcgctgtccccttctggttcgttttcctctttcggttcactctccccttctggttcgttttcctctttcggttcgctctctccatctggttcgctttcctcttctggttcgctgtccctttccggctcagtgctttcttccggttgtgtttcttctgttcccaattctccaattgtctgttcggattcttcaggctgatctttgctttgccattcggcctctgccttttccagtgcttcttctataatctgaattaagaagtctttctgtttcatgtgtttctttccgatgactacttttaatctctggaataattcctctgatacctgtactgctactgttcttactgctcccatgcttatttctccttttccttccagtctgttgaaatgttcttcaatgacctgttgtaaaaatttttgtgtgctgctttctgtgagttcaatctcttctcttactttctcatgtaagtccatcgggatctttccgcagatatttttcatttctgccataacctttctcctttctctttcgctacacacaacatactccaaagccgcatggaaagctattcacaatacccaccaaagataacgatgcattttatgccttacccctagcagatccaacaatgtatgtatcgtgcaatcataggcctcaccccctttacaaattttccatttgagatagaaaatccatcatctgatctggtatttcttccgatgatgggttcgttgtcgattgttccgtagtgccacatattcctaattctcgaacactttcttttatcgtcttttgaatgacttcttccagccattttcgatcctctttttccagaattgcctgaaccagatactggcttttctgcccttctggaacactttgaaatttctcccatgccctttggtgttctggttttttcagattcgggcggaacgaatacacagggcgtgtcatctcgcccacatctgctgtacaatccgttcataccctgttgcgttggcatggacgtcctctataaaaacggggcggcaaatcgcgtcctgtgtggtcacgtggcgttttaaaattgcagagcctccccccataaatacggtgggtactgcccggagatcaaacccggattctgtcaccgcagacagtattctttctatatatttccgtccgttttcctgtatgatccgtctggcctcttctgccatactgcaagattctccccgaagcacacgctcaatttgagtttctgtcacagacagtccggtatttctacgcacttgttctgctgtctcatcaatacatcggattactccaagttccagacttctgcacgttgctgcattcggaacagcattgtccagcctcataaggtcaacggtccagccaccaatatcaacaagcagaacagacggttcattcttcagatactctggatgcagagcaagcgcagagtatccctgtgggaacagtttcacatcttttattgttatctcatataactcactttcatataaaaatcgcactggctgctctttccgcaacagatactccctgaatccctgtttctctcttccaaaacttgaaagcggaagtccaacagccagaattacctctgtctttcgttccgctttccgatgcttgatttcttctgcaatggctgccaacgtcagcagataataattatcatttgacgttttattttttaccagcgtctgtcttcccgtaccgcagacataatactttccttgatattgcagaacattctgcatggtatacggctcgtaatcatacccaataattccacttgggaaagacacttgtcttgttttaatggcataatagccatgatcaattcctatgattatcgcaatcacatcctttcattttttctgtttaacgtaaggtcaaaaatgttgtcactgctgcaacggatcgttgcaaaagtgccattcgtgaacacttttctatgttccagcgtcccaaaacctgcggaaaatctggcttttttataccactatcgccagaggaacactactgttccttcccagccggttataaaagatccctctcccggcggcggtccagcctgtccgggggagggatatatcgcaagtttcctttttgaacaattgcctgtctttttatttttatgagatgtttttcctgcttttgtaaaatgggaagatactccggttctgtcaaaaacttccgtatataattgcccttttttcccagcttgttatcatttttcagcagttctatttctaccatgtaatgggtatctggatgaaatctcttctcacacaaaatgctgtccccttttatataatcagatttagccgattctcttgctgccgccaagagttcataaatacttacttccacctcttatcacctcccaaaagaccagaaaaaagcagacctcttaatcgaagtctgctcctgtcggatatggtaatcctctttcttcatattttttatcgatataatttcgaatccattccctgtattcttccgttaatgccagttcctgaaattctaacaaccacttttccccttttgcttcgtcatcaagccatcgatcttctatgcactccggctcatctaacattttcatcatcgcttcaaatggctcttttacatcatcaccaaattctttccataaggcgattccatagttctccagttcaaaaaattctgtcagatatgtcaatcgttccatatcccccaatgtcattcttttttcacctgacaataatgctcgatctcttttgccacatagatttaaaaattttctcttttccatctccacatccattatacttttacctcttcctgttaaaaataattccttattacgaaacattataaaatttaaattctttagaatcaatatatatgtttctgtattacgaaactttttattttataaggggagttcatcattatgcaaaagattagaccagatatggatattggtaaaaatatccaagcaattcgatataaaaacaatatgactcaagaccaagtagttgcaaaattaaatcttatgggtatctccatcaccaaaagtacctatgccaaactggaaacaaatcgcatgaacattaaggcatctgaattagttgcacttgcaaaactctttcataccgatatcaatgctttcttttccggcttgctatagttcgacattccccgactccctgtgtatataatagcatattaaaaataagaaccagtctatattcttatcggatataaaccagttcttttttcttatcaaataatataaaagtgacagggaattcagattcttatcttctgtcactcatgtaattattattctattttaaatttaatgaatttacccattcttgaatttctttttcaatgttattttctatataaacgtcatacacatttttccacattatctgtgtatactgttattttcaaccccataattataacttggtacacgctatacactactataaactgtactccattttagggaatcctagaaggatctcgtcataagaactcatatctatctcttttttcataatcgccggtctatattttttatcactcatttccacactgcttctggattttttattcatccagtcaagatcaagttttgtatatggaactttcggctcaatctcaaacaaatccgcttttgcttcctctgcgatcatctgtgctactttttttgttgttccgcttgcactgaaaaatgccactaattttttactcataataaaaagcccctttctatacgtatttttcacaaaaaaatagatgtataagatttacattcatcttacacatctattttaagctctatcgcttcattatgtctaatgcttatattgaattttgttttatgcctgaaaagcattaatctcctcaatcattttacggactgccaaagaatatgggatattccgtcgccaggcaatcaccgtactggttgtgatttcaggagaaattcttcgctgtacaagaatatcctctcgccaatactttgcagcaccctcaattgaaattggataccccaatccatttgccgccataactccggcattcgttccaagattactcgtaaaagcaatctgtaattttgaaaagtctttcccaaaccagttggcaagttcactttgaacgttcattctttccggcaggatcaagggctttccaataagatcttctttttttataaactctttttctgccagtggatcatccggccgcattccgacacaccagtgatcgcaatttgtgatccggatataatccagcccttcggtgtccaccggctccatgaataatgcaatatctacaagtcctttgttcatcatctcatacactgcatctgctgttgcagtatgcaatacaatctgaaccagcggatatttttctttatatgttttacatatcttcgccaatgtctccactgctgcaaattcaccgcatccaatggttatcgtgctctctacaacctcttcttttcctttcagttcctcaagcgtcctttcctcaagattaagaatctccaaggcacgcctttttaataaaattccttcatcagtgagcgatattttcttcccgtttcgaataaataatgttattcccaggtcctcttcaaatgccgccatttgtctggatagcgttggctgggtaatatgcaattgttctgctgcttttgtaaagctctgttcttttgctactgttaaaaaatagcgtaataatcttaattccatatctttatattcctacaaatttttcttgtaaccattctatcatattgcgtcccaggcatcatctatatcttcacctttaataataaatcgcacacaaatcaattatatcaagaagtaaattatactgcttctttgctgtatcgttcatttcatgattcatcggtgcgttctgtgaatacaacgttgcttccaaaagctttgatggtgctgaatgatataacatcaagtcttctacatgaattttcattctatttctgatatatcaaattcaaccgctttcattaaaatcttactctgtggcatcttttatttctattatatttaacattctaccgccaccttgatcacgccgttcctcttattttcaaaaagttcataggcttcttcgattctgctaagtggataggtgtgtgtgatcagtgattccgtgttgatcttaccttccgcgatcagtctcagcgtttcttcacaatcacaaccgtctactcctcctgttttaaaagtcagattctttccatacatatccggcagaggtaacgtctgggctttatcgtaaagtgccaccaccgtcacgattgcatttggccttgcgcattcccatgcaagacggaaagtagattctgctcctgcaacttcaagaacaacatccgctccaccatgctcgctgtttgcctgaataaaatcaaaacattcttccggcgaaactgtaagaacttccggataatgttccctgataaagtgcatacgcttttcgtctttttcacacatgatgatccgcttcggatttttcagcataacagacagtaaggtacagatacctgtaggaccggctccaatgatcagcaccgtgtcatcctcagtgatctcggaaatacgtgctgcccagtaaccggtggcaagtacatctcctacaaataacgcctgtctgtccgtaactttatccggaatcttattcagcccctgatctgcaaatggtacacggacatattctgcctgaccgccatcgatacggcatccaagagcccagccgccattttcatcggtacagttattcacataacctttcttgcagaaaaaacattctccacaaaaagtttctacatttaccgtcacccggtctcctggcttcacattcttcacagcagttccgacttcttccacaattccaaccatctcatgaccgactgtaatccccggcactgcccgtggaacgcttccatgcttaatgtgcaggtcactggaacaaatgctggcaagtgtcacctttacaatggcatctctttcatgcatcagcacaggctttggcttttccattaattcaaattttccttttgaaacataagtataagtctgcattcttttccccatcactttctataataatttatccagaatttccgctgctgatctattaccgaatacgccattgccaaataacaaccaagataagaaggtgcaccggataaaacgcataacagaaatacttgaaccacttgctatggtacccctgctctccatgatataaccagattggaatcagtgccagcagtgcaaagctctgctgtgcaatctcaaaatgatgtcccagaatcgttaccggataatacagattccccagcataactacattcaaataatacagcccgacaagctgtgccgcaaaagaaatccaggttttcttgcgaaaaaaataaaaaagcaataccatcagtattcctgcagcattgtaatctaccatggttatggttccaagcagaaaatccatcaaaagcacgaggcaaaccacaaaaaacgatatccatttcttttgtttcttctttgccttttcaatgatctgtatcgataacacccctaataaaaaggtccatagtacattttgatgaaacgggtaaaatacagaacttcccataatcaggttaaatggtatttctgaaattatggcaaatagaaaaagacgcagcatgtattttttcacattcgaagtataatagcatccttctgcgatcataaatgcgaaaatcggaaaagcaagtcttcctacgcatgtcatccattcctgtgctggaaatagtgtcgcccacaaatgatcacataacataaacagcattgccagaatatgtagtgtaaacgaatcaattcctctttttttctccataggttcttctccatccatccaggcatagatatctgccttttattcttttcttttcattatattatggagcattatccaacgtcaatcaactcttgcgtcctaatctatcactaattcagccagaactcaaatactcaacgcattctactcataaggggtgttcatttcttataatttatattatgcttagattaaacagaagggagtgaattatatggatttaatcaaaatcggaaaatatattgcagaaaaaagaaaagctcttggactgacgcagaagcaattggcagaaaaactgaatatgagtgacaaatcggtttctaaatgggaacgaggcatatgcctgccggacgtgtcaatttatatggaattgtgtagcatacttagaatcagcattaatgaatttcttgcaggtgaagatatcggtgctgaaaatgtaattgaaaaatcagacagcaatcttattcagattacaaaagagagtaaaaagaaacaaaaaaatttaaaaacaattcttgctgtagtaactgtttttgcagtaattgtctctgcgatccttggcactttattctttcacaaactgatacagccaaaaaattatattaccgcagttgatcagacaagtactgagatgaaaacagcagaattattatccggaacagacggcgcatatctttttcattattttacaaaagatgaatttaaaacactcaccatttatgtatctgaatatcagtctgggacactgatcagtaaaagtaaagtggctgatttggactatgacggaatcgattccccttccagaggcgtcattgctgttgtgccggattttgaatcttttaaggtaaaattaattgtagcagatgattatgcaaaatattctacggattttcctattttagaaaatatagaaaacagagaatattatggcagaagtgcaagccagataaaagggaagattccgattcagattcattcagcttcgacaatagaaggcaagactgctatcccttcagactctgaacagggattaatggctctaatctatggaaaagacgggctgtcagggattcctatcacggaaatggaaaaaggaatcgttgatgtggaaaatgattatgtatattatctttccttccaatttggggggtaatcaaaatttttgatgggatgtctttttgagggtttagattgacgattccttaagggtctatatcatttacaacaaatattataaggctttctatatttttacagtttcatagcactgcggatacagttctcaataaattcttctcccaaatctgtattcaggctgagatcaaagtttccggccgcaccccacatacgtcgggtgtaatagcgatagttatctgcacgcagtttttcatttttctgaaccgtagctttggcttctccctcagagatattctgtctctgtgccactcttctaattctgctcacaagaggtgctgaaaaaaatactttcaaacagtttccggaatttctgagaacgtaatctgcacaacggcctactatcacgcaattgccttttttcgcaagattgcgtacaacctggcattctgcctcgaaaattttatccttcggcgcttcatcctgtctgtctgtattcagatacatctgattgaccagatcataaagaaggctgtttgtcatgatctcctcgtttttcttaacgaattccggtgtgtatccggtggttcctgctgtcatctggataatctccgcatcataaaaatcatatctttcaggaatgcaagtttcttaccgatgaatctggcgataaagcctaccagaagggcagcaataacagtaccttctcttataccagccagtctgtccgttgcgattttcccctgatataaaagcatgcaatgaaattgccgcctggtttcaaaacacgccatatttcatgaaatgctttttgcttgtccggaaatgcataaaaaccatccatactgacaacagtatctaaaagcttaaaactatcgttctctaatcttcctgacattacgattcattaggtgtcttccaatatgtctataaacaaatgctttaaaagttgaaatttcttgatgatgttccttcaatagttcatctggacaatcataaacaccaaaatcctgattgattccctcgctctgaatataagtattgttcctatcaaaaaaatcgtaacttcaaactttatggaaactaactgccacgtcctacttttgaattaatgtgttttgctcatctctataaatttagaaaaatgccaaagtctattttcttttgtttttcacaaaactagcgaaatttttgatttcttccatttccgcttctgtatattcttctccgtcaaagtgagcggcgagagtggttgcttcagacggagcactcgtaagttcatctaatacatagcgaatatttttctcatttagcatacgtaatgattcaggtaaatgatttaagtcatatgagaaaaataatgatactaaatcttcttttggctttttatattctttagaaagtttttcaaatattttattcagttcagatccaagtaaaataggttgtgattcttgaatattacttgtaatatcccatcccattaaatacgcaggagaaacatttccaagttgagcggccgcttcaatcttatcagatggaatgtttgtaataatattattttcatatttataaagtgtttgtttagatacattgattttgtcagcaaactcgacttgactcatgttaagcttagtgcggagttcttttattctttctccaactgtcatatatttttcctccttttataaagtaacttaataatagcacaaaaatgttatgaatgcaacaaaaatagcttgacaagttacacaaatgtgatatactaaaagtaacttttaaagatacggaggtgaaaatgtgattaaaactgatgaattaagagggataatcgcaaaaaatggattatctcaaacagatgttgcaagaatgataggtattacaccaaaaacattctatgaaaagatgaaaaatggcgtgtttggtagtgatgaaattcaaattatgattgatgaattacatatggacgatccaatgtctattttttttgcacatgagtaacttataaagataccgaaggagacgtaaatgaagggagagaagaaccgtaccggtaaatagcagttcagagtaggaggtgagaaaatgcctgagacagtagaaaggaaacctttcaaatcaattcatatcgacatcgataaaggaatttgcttattaaatggtgaggcactttcaatggtgagccgatgtaacttggagttcaacaatgggaaatggtcacttttaatcacgagggatgaactttacagtcaggaaataagcaagaaaaactagtgtagcattgatacaattttgctgattatgtcaaaaattagattcactttattttgtaaacgattttccatgtagataatggcagaatctttcagtaaaaatccaaaatcagaataaagttttatcaaaccgtttttggataattcggtaagggcatcagcaatatcgtcttcgagaattccttgaagaaattctgtctggagagcagaggggtaagaaaagagaatagcctctgttttagacataccgatttttcttcggttttgatattcatcgtagataagacgaagaattctgtatgtatcgtttgtaagttgcatcatagtgtctccttttataattactcagcatggcagtgccggtagttaaagtataggagaaaatacaattatttgcaacagatgaagagggagcgcagattacttcggcgtaaccatggattattttctggaagagtaaggagggatgagatggaaatagtggttgtcctgtatattgttggaattgctttaataatgggatacctgataaacagatatcccagagaaagagtagctattatattcctttgcgcaatcgttgtattacaagttatccaaaaatgtcttcatcaaaaataaaaagaacaatgcatatgtaacagataaaagacgtggagatgcgaaaccgagtaataggctaaaaaatgcaattgctggtagttcaatccatataagagcgaatatcatacgaatttttgaacgatattgcctgtagttaatccgataagaaatactgcgaacagggagatgagcttgtttacataatttgtcatatgttttggaaatctgatcgcaaattcggaaccattgattatagccatatttgtcctcttgcagagcagatggtttttcaagccagcgaatctcttgacgtaaaacaggatcaataagaagagaatgtgagttttctaattcatagtatttagaaagaaaagcatttatgtcgttaagagatacttttttgtataaaaaaggttcgatttctaaaaagagtggatggtataccttatctagtctttcacgagctaaagtagataaattagagtttcgactaattagtaatgtaaagatgccaagagtaagagtgacagatggctctaataaaatatttataattttttctaaatcgatatttgatacaaacgaaagcatgatgattatcctttcataatttgatacggaaattataccagacaacagtaggacaaatcaacaagtacaaccagcaccgcataaacttcaatagaaagtaggtggtaagcatgaaacccgatatcgaaaaaatcatacaggtgatgatttctttattggaagaacaggaaaaagtgaaaattacatataccattgagaaaaccgcgtaagcggtaccagttggacaagcaaaggagggataagagatgttttgcaagatcgcaaagacactcagcgtaacggcaagtattatcggaattatgatgatggctggtgcgtgctcagtgaaaagtcaggagctgttttacttatatgcagcacttggaatcacaacacttactaccggagcatttgcactggaatatttccggatacgggaatggcagtaccggaaaaggaaaataagggaggcgaaggagcatgccagaagagaagcagcgtaagagcatcagagtaggcgagatcgataagatgatcaacaaactgcagtcgctggaaagggttgacggtacatccgggtattacaagaataatgcgatcgcatacttgtcggatctggcaaatcatttggataggataggcgtaaagacaataaaaatgcgcccggaagttgcagcttccagtggcgcacataacaaaaaactcaactaaattataggaaaatcggaggagaaagtcaatatgatcagagttgaaaaaggaacatgtgatattaagacatcggagggagtgccgggattaatggcagatttggcggttatcgtccggactcttaaaaagacactgacggagaagtgcgatcaaagcgaagccgaggcgaaggaagtaattaaccgggcggtggagcttggtcttgtaacggatgcggaacttgaatcggaagcgtttaaggtagcgggagaatttctgacaatgctgatgaataattcgtctctttagagaaggatgtgtacctaaagggggcgtgataatggaaaagaaaccattgattattcggtgctctgatgggtggatctacggcttgttcggttattacgaggaagcggtagaagtggcagaacagcatatagacggaacagaacatacatatatcatcatatgaaaagcgtgaggaaaagatggaaccttataaaatctatgattttgaagatgaaaaagcctggctgaaggggcggttaaacggaatcggcggaagtgatgcaagtgctgtggttggaaagaacccatacaaaacaaacattgagctgtttgaagaaaagaccggcagaaggattgcaccagacatttcagaaaagccttatgtgatctatgggaaagaggcggagcagttcatcagggagctgttccgcctggattatccacagtatcaggttgcgcaccatgaattccggatcttgcagagtctggagtatccgttcatgcaggcttctctggatggggagttggttgatcaggacggccggaaagggattctggagattaagaccaccaacattctgcaatctatgcaatatgagaaatggaaggaccggatcccggataactattacattcaggtgctgcattatctgcttgttaccggatatgagtttgttgttctccgggcgcatttgcggagcaactggggaacagatgtccggacacaggtgaagcattattttattgaaagagcagaagtccaggctgatctggattatctgcaggatgaagaaatgaaattttggaagtatgtggaaagcggacggaaaccgccgctgatacttccggagatctaaaaaagaaggaggagcgtatggaattacggattacaaatccgcaggaaagctggctgacagagcagatcctgtggaacaacgaggaattaaaggctgcgattgctgagaaggtaaaggactataagacgatcgcctacacagaggattcgctcaaggacatgaaagcggatcgggcagatctgaacaagctcaagaaagcttttgaggatgagcggaaacgtgtcaagaagatctgcatggagccgtacaccaagtttgagcagcaggtcaaggaaatcacagctctgatcgatgaaccgatcggactgattgactcccagattagagagattgatgaacgccgcaaggctgcaaaacgggaagagattgaagaactgtttgcgtccatcggattccagagctttgtgaagctggacatgatctgggatgaaaagtggctgaatgcaacggttacgctgccaaagattgaagagcagatgaagagccggatgtaccagatcggtacggatgtggtgacgatcagcaagcttccggagtttaagtttgaagcaatggaagtttaccggaagacactggatatgaaccaggcaatccaggaaggacagaggcttgccgatatccagaagagaaagctggaagcagaacgcatggaggccgagcggaaagcaagggaagcggaagaggcagcgaagcagcagactgcagctgaacaaaaggaagaacctgcagcagagaaggaaacagcatccgaatctgtaccggaagctccggaagaggaagcagtttcaattccggaagaggaagaaccggtattccagcttgacttccgtgtatggggaaccagggggcagattatggcactccgtgaatatatgttacagaatcagattcgattcggaaaggtggaataagacatggcagtacagaacagtttggcaagacaggatcagtcaatgaagttatcagtttatctgcagaacgatgcggtaaagaagcagatcaatcaggtcgttggtggaaagaatgggacaaggttcatttccagtattgtaagtgcggtgcagagtacaccggcgctgcaggagtgtacgagcccgagtatcgtaaacgctgcattactcggagaagcgctgaatctttcaccgtccccgcagctcggtcagttttatatggtcccgttcgataataagaagaaaggctgcaaggaagcacagttccagcttgggtataaaggatatattcagctggcaatccgttccggttactacaaaaagctcaatgtgcttgcaatcaaagaaggggagcttgtccggtatgatcctctggatgaagaagtggaggttaatctgattgatgatgatatcctccgggaggaagctccgaccatgggatacttcgcaatgttcgagtatgagaatggtttccggaagaccttgtactggtcaaagaagaaaatgcttgcacacgctgagaagtattcttttgcgttttacaaaaacggtggagcaaaatctctggaattactggaacagggcaagattccggaaaaggatatgtggaagtattcttcattctggtttaaggattttgacggaatggcactgaaaaccatgctccgtcagctgatcagcaaatggggaatcatgagtattgatcttcagaatgccattgataaggatatggcagtgatccatgaggacggaaagacagaatatgtggatgcagtgaaggcggaagatgatggagtggtatccgatcaggagttacaggaggtccaggaagaccagccggcagcgccaggaacacagcagccggatccgaagggtattgaggcatcattttttggatagatttaagaaaggggaaaaagaattatgcagcacattaacttagaaacatttgcaaacggagcatttaccgcgcaagtaaaccgggcgatcgaagaggtcacgaagaacatccaggatccgaacacggatgccggcacagcgagaaagattacggtaacgattgcatttaagccgaatcaggaaagaaacttcattgcaaccggagttcagacgaagacaacccttgcaccggcactcggagcagtcactgcattgagcatgggaaaagatctccgcaccggagaagtagaagcagtcgagatcggcaaccagattccaggacagatgtctgtacaggacgttccgggagttgtaccagaagtaggaactacagtggtagatggaaaagtaattgataaagctactggagaagttgtggcggattcagttccggaacacgcaggcaaagtaattgatttaagaacagcaaaacaggcataggaggagtaaaaacgatggaaggattaaaagaagcaattgaatttatcacaaatctgaaagaaggcagcatggagccgaaggtgcttgatatcaacggcaatacatactgtaataaaaatctcacaagatatcattatttcccgaaggcagattccctgagtgtcaacaccctgacatccattgtggattatatcaaggggaaaccggaagaactccgggagaccatgatcctgcatgtgatcagtccgacagaagtaagactgtattccggactggtggacgaacgcaacagggaggagcttatgagggcagatgccattgtaaatgaattccggtttgaccgttattatgaccaggaacgttttctgatcgagctgcaggcaaacttcattgaatccgatgatctgactgtcctgaagcaggttgccggaaatatcgagtcaggaacaacggcgaattatgatgatgatggtgtcagccagaaaaccacgatcaagagcgggattgcaaataagacggatgtgatcgtaccgaatccggtgaagctcagaccgtatcgtacctttgcagaaatcgagcagccacagagcagttatgtattccggatccaggacggtgaccgtggaccatccttcaagcttgtggaagcagacggcggtttatggaagaatgcaaccatgaagaaaatcaaagaatatctggcatatgaactggcagaggaacttgaaaagtaccacattacgattatcgcgtagaaaataacatctccttaaaaataatatatcacacgtaacctgataacaagaaagcaagccggcattatgcagcatctgttgtgtaagtgccggcagaaaggaaaaaaggaaatgacatcggtaatgtttacagttccgggcaagccgcagggaaaagccagggcgcggacgtattataatgcatcgacaaagaagcactgttccaccacaccggataacacggtcctgtatgagaacttcatcaaagatcggtatctgcagatggcaaagggagcgttcctggaaagagaaaagcctgtgacgctccggattattgcaaggtatcttccgccaaagagcgtatcgaagaaacggaagcttgatatgctagagggaagagagctgccgctgaagaaaccggatatggacaatattgtgaaggtggtagcagatgcactgaacggtgttgcttatcatgatgatacgcagatcgcactggtccaggcaaagaaatgttattcggcagtagaaggactggatgtgacagttgaggagtataccggataaaaggaaggaaatgtaagaagtggcaggacgaccaaaacaaggaattgattattccggatggtcggttgacatattcgatggtgataagaaaatagacaaacttctcgatgcaaaaggatggaagggattcgggatctacttctttttgtgtcaaagggcatataaagtaaatggatatttttatgaatggggctatgacgactgtgcaacgacagcaaggcggatgggcggcggcatcagttccggtacagtaaaagagactgtggattactgcctgcaagtggatctttttgataaagggttatttgacaggtgggggatcttgaccagtagaggtatccagcgtcgtttttgggcggtactatccgagcggcggagtaaaacagtatatggtgagtattggcttttgaaacccgaagaatgcaaaggtctagttaaagtcaacttattttcggatgtgcaaccgacaaatgatgatgtgcaagggacaaatgaggattcgctttatagaaaggaaagtaaagtaaagaaaagtaatgtatataagggcgctttcagcgattcttcccttgaatcagcttttcagttctatctccttgtccgatcacagaactggggagagatctctgatgagcaagtaaacgctttgagagaggatctcctatcattgtcctctgatctggctgaacagaaagcaatcctgaataaagctgcagctggtggatggaagaatttatatcctgttcaaagcaagagaaggccaaaaacaaagaagcagccagagaaacagggaaagtttaagaattttgaagagcgtgaatatgaggacatgacagatcttacaaggaagttgatgcagcgatgaaaaagaagaatgggaaacggagtacgttcctgagaactggaagcaggaagaaacggaagattatcaagcgtgggaagtaggaggattgatcatgctgatagaaaagacattgaaagaggcattggcagactacataaaaggtaaaccagtgacggtattatggacaagggatgatggaagtatggatgtcagattactgtcagacattctggaacaggaagaaaatcattttctggtaaacgttccaggatatcacaatccagaatttgcacaggaagtagctgaaatggtagatcagaagagaatagatgactgtaacagagaagtagcaccggcagggacaacggagaaggacggaagtaccaccccccccctcacagagccggattcggttgtgattccggcagaaaataaaagggagaaagcattggaactggcgaaagaaggaaaaggtgctgcggagatcgcaagaatgatcgatgcaaaatatagtaccgtgtattcctggctgaatccggataagtgcaagaaaccaaagccggaaaataagacagccagtaatgcggaccggcacaaatgtaaaacctgcatgttccggacgacaggatataatgcgaagggagccggctgttcctatatcgagataacagggcacagcagaggatgctccgtggaagagtgcagcgtgtatcaaaaggacaatgcagtgtcaaagcggaagatgaaaggattttatgaatgagttgggcagataagcagttaaagaaacataagctccgaaagcagatcaaagagatcatggatagtccagagtttcaaaaggaacgccagaaggaattggataaacacacagcagaggcaatgaactgttttctgctgatcagtgtagattatttgtaccggaactatcattgcaagagaaagggagttttgaaatatttggaatttgttttacaccagatgcattttgcacagaaggacgaggaatattttcagctgatgaatgaagagctggagagggaagttggtgtgaatgtgctggggacgggatatgaaatctaatgttccaggaatcaagattatgccatatacagcaacattccgtatcaccaaaggaaaagataaaggacttgttgcattccgaccgctctgtaggtcatgtgcttacagatacggacgtggagttgtcgaatgtgacggaaacacatacatggaaccggatgaatttagcgagaagaaatggaaggaggaacagtaaatgggatgcagaggaaaatgtgcgataaacgaaaacaatcatatgtgctgcttggaatgcccggattgcgtgggttgcccgatgcagtgcgattcttcggacgagtatgaatttgcagaggattgcccggattatgtggaggaggaagaagatgagtagaagatttgatattggtgatcgtattatctgtacagaatcgggagtgtctggaatctgcgaaaagttttattatcctacagcttgtgaagagcagacaatggtagaaacagcggatggcaggcattatcacgcacctacaagaacatggaagaaagtagatgttattactgcaatttgctttccaagaaacagcggacaatcagctataatccaggcacttattgatgggtgtcaaaagaatcgtaagcatggattgatgagaaaggcggtaaaagatgagaataattagtcagtataaagagtttgatttaccttacgaggaaacaacgattcgagctttcgacaatggaacagtagctgcattttcgttaaccgatttggaaagtgatgcttttattacaatggcgaagtattccaccgaagagaaagcaattaaggctatggagatgtgtagaaaacagtatatggacggtgaatacaatcgaaattcactatctggagttgctgagagcattggacggttaagtgagggacttgcttcggtttttaaagagggcgtttgtcaaacatttgtttttaaatttccggcagatgaagaggtgcaagagtatggaaaataagaaattaaaagaatatctggatgaattcaaggatgatgcagcactccacgttattgtcgcaaatccacaggacagaaaaatatatgtaccgtatgagttaaatatgatctgtgataagggacagaaagatccggtgttatgtattgaagttgggcaacctcaggatatggatgcagaattggtagaagcagctataaccattctgatagcaatgaaatggactggatcggcatggtgcttatgggcgttttgcattccggctatattagagtgatgagggatagaaggtgataatttgcaggagaaacgaagcagaaaagaacagcggcgggacaggcagcagcattatgaagagttggagagccggcatgatgcaaaggcgttggagagattcaaaagaccggcttaccagagcgtaagcgttgcggaatatttggcgaagaagtatgacattacagcggaggtggataccattgcagaccgaagaaaaagaaatgacggaaaatgagaaaaagaaagagtatctgagacagtacaggatccatgtccggcgaatacatagaatcaatgcggaaattgcagagttacgatctatgaagatttccccgtcgatgaataatgacgggatgccgcacgggagcagccagggcgatttgtcaggttatgcagcagagcttgaccgtatggtatcggagctgataaaagaacgatatatgcggatggtggaatatcaggagattgtacggcagatcaaaaggctgcgtagcgaaaatgagaaagacgtgctgttttaccggtatattcgtgggatggattggtgggagattgcagagaagatgaagttttcagaacgacagatctacagatttcacgggaaggcactggtaaattttcggcttccgaggaaagatgtcagtgaatgtcagtaacatctgtggtattatgataacatcgagaagcgaaagaaaagagcttttcggatgtgacattttcacaataagttctccgacggtaagtgtgataaaagggcgatctggtgacaggtcgtctttttcgttgccaagtgccagaaaaagaggtattatgaggttagatttatcggtggagggaaagtatggatataatattatggggaattggaaatagtttggtgataatgggacttttatttgcttcattaaacggaataaatatggggaaggataatatcctagaaggtgtgcaaaatgcaagcgctagattaccgttgcttaagaatgacagaggaaaagttaaagtaataaaagaagaaaagcggaaggcttatagattggcaaaaggaattgtggcagaaaagacaaatttgaatatcggttttggaatgtctactgtaggaacatttttgcttgcaattttcgatacaaaaagacctgagaaattgtcgatgagagttatagaaattgttgtgtgttgtgcagtgtgcattgcagtttgggcggcattaaaagatacgataacaaggggcaaaaataaggagattagagaagaaataaaaaagaatgaagacgccacaataccggttggcgcattggtatttcaggaagatgatgagcattagcaaaagtcaaaacaacacgaatgagaggtgatggtacatggcgagagcaccggatccacgaatcgaacaggcgaaagccatgtacctacagggcatgaagttggttgagattgcaagtcagctaagtttgccagaaggaacagttcggcgttggaagtgtactcataaatgggaaaacgaacgttcgggtatgagctcggataagaaaacgaacgttcggataagaaaaagaggtggacagccaaagaataaaaatgctgtcggaaatggcggtggagcacctgaacagaataagaatgctgaaaaatacggattctttagcaagtatctcccggatgaaacacgggagattttttctgccattgaacaggctgatccgcttgatctgttgtggcatcagatacagattgcctatgctgcaatcgttagagcgcagagaattgcatatgttaaagatcaggcagacaagaccgttgagaaggtcgaagagaaagacgggaacgtaattggcgagaaatgggaagtacaacaggcatgggacaaacaggagaacttcctgaaggcgcaggcaagagcacaaggggagcttcgggcaatgatcaagcagtatgatgaaatgctgcataaagactgggaagctgcaagtgaagaacagaaagccagaattgaacagatccgtacaaacaccgccaaaatgagtggtggaaacggagatgaggatgaaggagtagagattatcaatgacgcaccagaagaaacaggtccggatatcggagatcataattccgaagtatctgcaaatatttaacaaccgaagtatcaagcacatcatcctgacttctgggagagcaggaacaaagtccagttatgcttccatccggtcagattatcagcttgtatcagatgccaacggttccgttgttgtgctgcgtaagcatcataacaagctccggaagacggtatacaaggaaatgctgcgggggatcagccgtttgcaaataccgaaaaacaagttccgaattacgaaatccccgatggaaatcacttacaagaagtacgggacaacaatgtactttgccggatcagacggtattgacgatacaaagggtatcattgacgaggataaaccgatcaagctggttgtcctggatgaactgacagagttctttgatgatggtgaaggcgaagatgagctgaccaacattgaagcaacgtttgtccgtggaaataagggtggattccagatgatttatttgtacaaccctccaaagaacccaaatgctccgatcaatctgtggtgcaagaaaatggagaagcgtgaggactgcattcacattcacacagattaccgggatgtgccggtggactggcttggtcctgatctgattgcatcggcggagatgatgaagaaagcagatccgaagatgtaccggtgggtatggctcggcgaagcgattggcgtggatgagctgatctattatatgttttctgatcggcacagacaaaagccggatccggacaggagatatgaccggatttacattggaggtgactacggtcagcagaatgcgacaacctttgaagcgtttggcttggacacctaccggaagaagtttccgggacttggagaatattatcacagtggacgggaatctggaaggcagaaaagcccgtctgaatatgcaaaagatctggttgagttcatggatgagctgcatgaacagtatgagaaccggagcttttatatttttctggatccgtctgcaaaaggtctggcagaagagattagaagagccactagaaccggactggactatcaggtgtttctgcgggatgcggaaaatgatgtggctcttggaatcagccgggtacagaaagcactggtattcgatatcatgtcgatttccccgaagcaggaatatgcggtgcaggagtttggaacatacgagtatgataagaaatccattgaaaaggggaaagaagtgccggtgaaggaagcggatcactgcatggatgccatacgctatgtggttatgggcgcctggagcaagatcaaacattggctacctaaagatgaaacgccggaagaaatagacatatgcgatatcagcagcagggaggtgagagaagaggatgaatatctttaattatttcaggaaaaaaagaatcgatacggtagatgcttcgttctaccggaagatcgatgagtggatcagctggtacaattccaatgtccggcagtttacgttctacaaggtgaataccggacgaggtacaagtaaacgatgccgtaggaagagcatgggaatggcaaagaaactgtcagaggatattgcagatctgctccttaatgagagagttatgatcacactggaggatgaaatgacacagaaatttgtgcagaaggttctggataacaatcacttcctggttatgggaaacgactatcaggaacgaaaagcgtattccgggaccgtggcatatatcccttatctgtacaatgcggttgtgcgggaggatgggacgatatctgcaggtgagattggaattaactatgtagatgccaagaacatctatccggtcagctggaataacggggaggttacggagtgcatttttacgttcgtgcatacagttcgtcagaagaaatacgtgcagattcagtttcacaggattgaatcaaaaggaatgtatgtgattgaaaacagcgtcctggaatgtgcaaaaggcagtgtggaaggtcgtgagctgacagaacaggaatggaaacagctgaaaccatttgcaaatctggcatccagaacagagacaggatccacagaaccgcagtttgttatcgacaggctgaatatcacaaacaatgcgggcgaatgtaatccaatgggaattgcgatttttgcaaacgccatagataccttaaaaaaactagacacggagtttgattcctactgcaatgagttcgatctgggaagaaaaagaatctttgttgctccggaaatgctgacgaatgaggacggatccccaacctttgatccggatgatggtgtgttctattcgcttccggaagattacgataagaaccagaccggtctgatcaaggaagtggacatgagcctccgggtagaacagcacagtaaggcaatcaatgatgatctgaattatctgtctctgaaatgcggattcggtacggaaagataccggtttgacggagcaggagcgaagacagcaactgagatcatttcggagaactcagatatgtaccgtatgctgaagaagcatgagataatcctggaagatgtcataaagcggctggtcagaatcattatccggctcggtattgtgacaggaaatacactggaccagaacacagatattgtgattgatttcgatgattctatcattgaggataagggcgcagagacattcaggaacagcttcgttttatcatcaagacgacaggagcaacccttgcaccgatggacagctggctgatcctcagagggatcaagacgcttggagtccgtatggacagggcacaggaaaatgcactgaagatcgcacattttctggagaagcaggagtatgtgacaagggtgctttatccgggacttgaatcacatccgggctacgaactgatgaaaaagcaggcaagaggatttggttcgatcctgacctttgaagtagattccaaagagagagcatatcacattctggaaaatgtaaaactgatccagtttgcggaaagcctcggaggaactgagactctgatcacttatccgatcactcagacgcatgcggatctttccaaagaagagcttgaccggaacggaattacagacaggattctgagattgtctgttggaattgagggagcagaggatctgatcgcagatctggaagctgtattaaagtaaatcaaatagaattgtgtataaagcggaagatatctgtaaccgaaggtgtattaccggacagatagccggcagatggaatatgaccgtgcagataaggaagtggcagaaatgagtaaaataaaggtaaatgaacagcgggcagtcgatgaatttcaggaactgactgcgatcgatgcaccaagctttggggagcgtcagatggcagaccggctgatcgtgaaattaaaagaacttggttttgaagtagaggaagacaatgccggaggacatttcggaggaaatgccggaaacttatatgcatatcttccgggagatcttccgggagatccggtccttttgtccggccatatggatacggttgagccgtccaaaggcaagaaagggatcatcggagaagacggtgtgatccgttccgcaggaaaagcagttcttggagctgatgatgtggcaggacttgtggagattctggaaggaatccgcagtgtaaaagaagcgggagtaccacaccgggatatcgagattctttttgcaattgcagaagagctttatatcaagggcagcagcgtatttgatttttcaaaggttcgtgcaaaagaagcctatgtactggatatcagcggaccggttggaagcgcggcatataaagcaccgtctctgatttcttatcaggtggtagtaaccgggaaggcatcccacgccggatttgatccggagcacggcgttcatgcgatcgctattgcatccgaagcgatcacgcagatcagtcagggacatgtggatgaagagacaacctgcaatatcggattgatcgaaggtgggagcggaacgaacattgttccggaaaaatgtatcgtaaagggggaaatccggagctattctcatgaaaaagcgactcgttgtgtagaagaagtgggaaataccttcaaaaaggtggctgaaaaacacggagctgaatcagaacttacctgcgaagttcatctgatcgcttatgagacagcaaaagacagtgtgccggtaaaacggtttgaaagagtaagcaaagagctgggacttgcaggaaatcttgtagagacatttggcggaagtgataacaacagctttgcgaagaacgggattcctggactggtgctgtcaaatggaatgtaccaggcacattcggtaaatgaatatacgacaatcaaagatcttgtgacaggagcagaactgatcgccgggctgatcaccgatgagcagtagtggatgttattatacagaaaagacgccaaaagcgtcttttttatattgatagaagaaaaacagataaaacatattgaaattaaatgtttttaaaataattccctattaacctattgacaaagtaggtaaaagtagatataatgcaactatcaaatttgaaagatcactatagagatcacgatacatcagacagtagaaaagagaggtagaaaaatatgagcgattataaatttgaaacacttcagcttcacgtaggacaggaagaaccagatccggcatctgatgccagagcagtaccgatttaccagacaacatcttatgtatttaagaactctgcacatgcagcagcaagattcggacttgcagatgcaggtaacatttacggacgtctgacaaactctacacaggacgtatttgaaaagagaatcgcagcacttgaaggtggtgtggcagctcttgcaacagcatctggagcagctgcaattacatataccatcgaagcacttgcagcagatggcggacatatcgtagcgcagaagacaatctacggtggaagcttcaaccttcttgaacacacactgacacattacggaatcacaactacatttgtagatgcacataacttgaaagaagtagaagatgcaattcaggataacacaagagccatctatcttgaaactcttggtaatccgaacagtgatatcccggatatcgatgtgatcgctgaaattgcacacaagcatggacttccgcttgtaatcgacaacacattcggaacaccgtatctgatccgtccgatcgaacatggagcagacatcgttgtacattctgctaccaaattcatcggtggacacggaacaactcttggtggaatcatcgtagattccggcaaatttgactggaaagcaagtggaaaatacccggcaatcgcagatgcaaacccaagctatcacggagtatctttcgtagatgcagcaggtccggcagcatttgtaacttacatccgtgcaatccttcttcgtgatatgggagcaacaatttctccatttaacgcattccttcttctgcagggaacagagacactgtcacttagaattgaccgtcatgtagaaaatacaaagaaagtagtagaatacctctctaatcatccaatggtagagcatgtgaaccatccgtcactgccgaatcatccggatcatgcactttatgaaaaatatttcccgaatggtggagcatctatcttcacattcgagatcaaaggcggacaggaagaagctcacaagttcatcgacaacctgaagatcttttcgctgcttgcaaatgttgcggatgttaagagccttgttatccatccggcaacaacaacacattctcagctgacagaagaagaactgcttgatcagggaatcaaaccgaacacaatccgtctttctatcggtacagaacatatcgatgatatcatcgcagatcttgaaggtggatttgcagcggttcagggcaaataaatattatacacacaggaattttggacggaggtttttcgaaaccttcgtctttttcgatgtgcacagaaaattttaaggagaaaacactatgacaaaggcacagatcagaaaaaatgcttttctgaaatccattccgatcatgtgcagctacattttcgtaagcatggcatatgggattatgatggaaaatgccggatttggctggtactattcactgtttgtcagtcttaccgtatataccggggcattccagtttgttctgatcacatttttatccagtggagcttcggttgtgacgattgtactgacagcgtttctgatgaacagcagacagactttttacagccttacttttctgaaggattttcagaagatgggcaggcgcaagctctatatgatccacacgatgacggatgagacctatgcggtaaactgtacgctcgacctcccggaaaaagagaaggaggatacgatgttcttgattgcatttttcagccggtgttactggatggcgggggcagttctcggaggagtcctggggcagctgctcccgtttgatatggaagggatcgatttttgtatgacggcactgtttgtgattatttttatcgatcagtgggaaaagaccagaaaacacattccggcagtgaccggactcgggatcgggattttgtgcctggtgatcttcgggcagaaaagctttatgcttccggcacttcttatcacatccggaatcctggtcattatggaaaagggaggaaaaattgtatgacgacgggcggaattttactggcagttctggtatcggcagtttgcacgttcgcacttcgggcactgccgtttctggcatttaacggagaaagaaatatgccgttgtggttggacagactggggcaggtgcttccggctgcgatcatggcagttctgatcgtttactgtctgaaggacgtgggcagcgatttaagaggaattgcatttccgaaaggaattgcggtagtggttgttgcagttagctataaatggaagcacaacacacttataagtattgcagtgggaacgggcctgtatatggtgctgttaagagtattgtaagagttgcggcagtcaggagtgttgaaaatgctgtgcgataagcggaaatccagtattttcggatggatctccctttgaccagatgcagagattatgctatgatatgtaccgatacatgcgcattttttatttgacaacaatccagatggaactttctgttcaataaagaggattatgtgtcaggggacattctttttacaaggagaaaatcaatgagtatagatattacgatcgaggaaatggaagcgcttcctgcagagtcctacgagctttttgatatccgtggcgagattgagcgcgcccatggaatcctgccgaattcgacggcaagctcagcagatgtactgatggagaatccgccggaagataaggaaaagaagatcattatctgctgcagcagaggacagatcagcagggatatcgcagaagaactgcaggggcagggatatgaagcatacagcctgaagggcggttatgttggatggctgatggcagatatgaagaaaaaggaagcagatgatgtctgtgaacatgtggagcttagtatccgcaagaaattcaaaaagaagatctggtccaaatttacaaaagctgtcagagaatatgaactggtcaaagaaggtgaccggatcgcagtatgtatttccggtggaaaagattcaatgctgatggcaaagcttttccaggaattaaagcgtcacaacaaatttaactttgaagtaaagttcctggtgatggatccgggatacagtccggagaaccgaaaggtcattgaagaaaatgcaaggaagatgaagattccgatccagatctttgaatccaatatttttgaatcggtatttgagattgaaaaatcaccgtgttatatctgtgcaaggatgagacgtggatatctttataattttgcacagcagatgggctgcaacaaaatcgcactgggacatcattatgatgatgtgatcgagacgatcctgatgggaatgctctacagtgcacaggtgcagactatgatgccgaagcttcacagtacaaattttgaagggatggaactgatccgcccgatgtatctgatccgtgaggatgacatcaaggcatggagagattacaatgatctgcattttatccagtgtgcatgtaagtttaccgatacctgtacaacctgcaacaatgaagaaaatcagtcaaagcgtatggaaatcaaaaagctgattgcagagcttaagaagacgaacccgtttgtggagggcaatattttcaagagtgtggaaaatgtcaatctggatacggttgtcggttacaaggcaaaaggtgtaagacacaatttcctggatacttacgatgattaaaaatgactggatgtgccagggcatatctgagatataaagaagaatgaaattcccgccggacaggtacaggatctgcccggcgggaattttgagattaaatgacaggaatattgacctgtaccagaattcctgacgttgatcaggataaaacggtttcctgctggttcttgatatcgtggtaaataacaaaacgtccacgtccgttttgcttagctgtatatagagcatgatcagcaaggcggtataactggctgaaagattcagcatccgttggagcaacagcacagccgatactgcaggaaagtttccgaccatttagttccgggatatctatattttgaagatttgtatagagcttttgcaaatgcagatggatactgtaatccagacgtacatttttcatcaggatcataaattcgtcaccaccgacacgaccgatgatatcggttgtccggaactgttctttcagaaatccggcaaatattttcagtacctggtcaccggttgcatgtccataagtatcattgatctgcttgaaataatccatatcgatcatcattaaagcctgtaaatcttcaaaatctttttcgcgcagccattcggaaatcgtgtgttctgcataaactttgttcagaagtccggtcagagcatctgtatgcgcctggcgaagaagcgaagtctgattcttctggttgatcttccagagtgcgaagatcagaagcagcacaatgcagataaaaaaggcgaacagaatgatttcaaagttgttgataaaagcaaagtgctgacgggcttcgacagcaggaacgatatagcagagcatccagtcgttgtactttagtggctggtaggaaatatagcgtgcatgtgataaatctgctgtaatcttgcggcagtttgcgtgtccttgcttaaaatcttcctgaagggtagcaccatcttccgaggtctgaaatacccagtcagaggaagaagtaaaaaagttctctcggatttcgttgtgtgtagattcaatggaaatgatgttgccatccgagtctgtgataaatgagtagccggaaccggaatacagatcctcaaagagcatggtagtcagttccgtaacatcgatggagcctccaaagacaccgataatattctgatctttgtcataaacaggaactgtgaggacaacaagggtttcgttgtctacgctgcttgacagaggagaactaatgacgcgtctgccttccaatgtcttttgaaaatagttccgtgaacttgcatcggtcttctttccatcgctggagcgcccgataccgtctgtagaaaaaagcataagccgatgataggagctggaagaagccagttcagcaagaagctgaagattatcgttgctgaacagatcggaagttgttccgaagtatgcagcaggactctccagaaattcatattctttttccaggaccagttccaggtgatccttttgctgcagtgtgtttttttgaagaacattctgtacacttttatcaacgctctgttgtacaaaccagaaaaaaatcagaagtgtgaacgtcattacaataaggaacgaaatgatagccgttccgtattgcatcagttcatgacgtgataattttttcatgtaaaatccccctcatattgtgcgttaacaaataagtaattagattttctaaattataccataaatgttctgggatgtcatcgaatttgtatgtgaaatggataggaaatatacataataaacaaaaaatgaacaaaaaaagagagaataacgtaaaaaataacaaaagcattacgttattctctcttagttatacgttattgtttattttgcaagccggtagattgcatccagataaatcttcatccagagatccagtttatctagctccagacattcatttgtctgatgcatcagatcaggctggtctgggaggagtgcgccgaaagcgacacagttatccagtgctcttgcgtaagagcaggcaccgtctaccagaggttttgcggacatatcaccggtgacattgcggtaggattccatcagagtctgaaccaggaaagaatcctcaggtacgtggatagattcagttgcatatgggttctcaaaacggaatccggaaccgataagctgtttctgaatgagctcctgaacctgggcgcaccggtaagtaaccggtacacggttgtcgatggagaaaatcaccttatgatcgcatacttcgacctttccgacattgaaacttaatctgccggagatctcatctgtaagatcgattccaagtccctttccggtcaggtcaaaaccgatgtgctccatgtaaaatgtggcaatccttgccaactcattttccggagaaagctcagataaagctgacatcagtccgctgatcgcattgattccggtagaaggatgtgctgcgtgtgcggcaaaaccttctgcggtcagccggagggatgcacccgcattttctactgtgaaatggcatctggtctgtgtctcccaggagagcaggctcttgcggatcacggtttccagttcgagaggaagcaggacggaagcatggtctgcgactgcgttaaatgcatttccaccggataaagtgatatcctctgagacatcggttacaagctgatactgaaagacgcctttttcagcgtaaataagtgggaatactgcatccggtgtgaaggacatctgtggagcagggatctttttcttgttgaaataatagtccatgcatttccagtctgtctcttcattcgcacctacaataaaacggatttttttgctgagtggcacacccatttcttttaaaatcttgactgcatggaggcaggcaagaagaggacctttatcatcaagtacgccacgaccatacagctttccgtcaatgatttccggtttaaacggatcacatacccagctgccactgcatggaaccacgtccacatgaccgaggattccgagagtttcttcctgatccccataatctgcgtgtccggcatagtgatcaaaattttctgttttaagaccaatggattctgccgtttcgagaaagcagtcaagtgctttggcagcgcctgcaccgaaaggcattcctgcatccggtgcggcttccacgctgtctatggacaccagtttcataatatcctggatcagactttcacggtctgtctgtatttgtttttcaaaatccataagagtttacctccttatgcaagaagcttatacatataactgaatgatcagcatgatcgcactgaagacggtagtcatacccatcagcggcatgatgaatttcagccatttatcataagtaacatccaccatcgcaagggatgcaaggatcagaccggttggtgtgatgaaagaaatcagaccaagaccgtatgcataagcagatacgattgctgatcttgaaacacctacggtgtcggcaagcggagccatgatcgggatggacagaactgcaagccctgaggaagaggaaataaagaatccgagtacgataaatacaagcatcatcaagatgatgaatacgatcggattcattccactgatcgcacctgagaagaattccaggatggtgtcagaaatcataccgtcttccagaatgatgttgataccacgtgccacaccgactaccagagctacgcccatcaggtcagcggcaccaccgataaactgatccataaagttcttttcgccgattcctgaagtaaatgcaagcaggatcgcgcaggcaaggaagagggcagtcatgttgtcgaaccaccagccctgagctacaagtccccatacaagcacaccgaaggatacgccgaatacgaggagggaaagcttcatttttccggtaaattcaggaacctcgccctgatgaccgaatttctgcatatgatgttcatactggtcgtaacagattgattttgtaggatcttcttttaccttctttgcatagcgaaggatgtagatcaaagtgatcagagtgccgagtaccagagcaacaccacggattcccataccgtcagcaaggctgattccggctgcattggatgcgtttccgacagagaacgggttgatggtcgggaacatggttccgatagaagatcccatgtaaattgcagcgatacaaaccataacatcatatccggctgcaaggaataccggtacaaggatcgggtaaagtgcaatggtttcttctgcaagaccgaaggtagttccaccggctgcgataataatcgtgatcaggatgatcaggatatattctttgctcttggtgactttggaaagtgccgcgattgccgcattgaatgcacccatataattcaggacaccgatacatccgccgaggataaatacaaaaaggatgatatcaatggtatcgtaaacaccactgattgctgcaaggaggattttaaatacgccctgcggttcctgatcgactctctcgtaggttccaggaacagcgatcggtttgctgatacttccatcaaggaatttatttaagtttccggtaacacccagctcgtccaaggattcctgggtaggagccatttctgtcacttcaccttccggtgttgtgatttcaaatacatcatagtctgcgttgtacgttaatttggaataaagccctgccggtaccactgcagttaaaattgcagcgaaaataaggacgataaataatacagtgagcgcagaagggaaagatatttttttctttttcataatcagtatctccgtttcctatttggtatttactcatttgcaaagatttttacaagttctacaatgacacggacagctgcttccataccttcgatggtgacgtgctccagtggtccgtgatatccgtgtccgcctgttccaaggttcgggcaaggaagacctttaaaggaaagcttgcagccgtctgtacctccgcggattggagaaatatcctccggaacatttgctttcgcacaggcctctctagcataatcaatcagatacatgtgatctttgatgatacattccatgttctggtattcatcggtaagtgtcagtgtgactgtaccctcgccccagagctcatttaagatcttttcgatatggcggagcgtattgcggcgggcttcaaagcttgcgctgtcgtggtcgcggatgatgtattcggatacggcatgtccttcatctccgtgtatgctcagaagatggtagaatccttcatactgttcggtatgacgcggaatctcgaatcttgggagcatattgttgatatctgcggcaatgagaacggcattgatcatcacatcttttgcagaacccggatgtacatttttgccattgatctcaaattttgcttcgcatgcattgaagttctgatactggatctcgccttcgccgtccccgtccagcgtataggcaacctccgcgtcaaaagtatcaaaatcaaaatgtgcagcgccgctgccacattcttcgtccggtgtaaatgcgacactgatctgtccgtgtggaatcttttctgtgatcaggatctcaagaagctgcatgatctcagcaataccggctttgtcgtcaactccgaggatggtatttccatcggaagtgatgagtgtacgtccctttaatcctttcagatgcgggaaatctttggttgtaagaacccgtccactgtctccgagaacgagatcacatccgtcataatctggtgtacagaccggatggatttctgcctcgcaaaattctggtacagtatccatatgtgcgataagtccaagctttttcttattttcatatcctggtgttgctgcaaggattccataaacgaagcatttatcgtccagaacaaccttgtcaagtccgagttctttcagttcatcagcaaggattcttgcaagatcaaactgacactgagaggttggaactgtatcgctgttttcatcgcatggtgttttgattgcgatgtatttgagtaaccttttttctactttcatttgtattctccttccacatatttgtcatacggatgactccgtggcttgtgtttttatgctatcattttatccgggtaaatcagaaaagacaaaagaggtgcgttttattgacacgaaaaaatcagacgtgttattattgaaaaaagagaaaaaatatggtgcatactagaaaattggggaaatgcgttaaaatttatgcacatatcataaaaaaattgatttaaaggaaagaaaattggtatgaatgtagatgagaaggtagggcgtaatattagaaaataccggatggcatataatatgacgctgaaagaacttgctgtaagactgcataagagtgtgtcgacagtttctaaatacgaaaaaggggatatttcattggatatttcgacatttcttgaattgtctaagatttttaaggtgtcacctcttgcaattatcggagatgagattgctgaggaagaggaagaatgtacttatgcggagacaattgaaaaattgtacatgtacagctatgacgggattggaaaagtaattgtcaaaagtttgattgaacagcaggcggtggaaggaaagaataacaaatataaagtgcatttgtttaatgatgtaagtgaggtcaaagaaccgggggaatgtggcggactttatactggtgagtatgaaaaggaaggatttatcggaacctatatgcttcataaccaggctctgaaatcagaacatatcatgatctcctgtgtaaataatctggtgaatccgggacagcagctggcactggtgtccggtctctctaattatacgatgcttccggtgacctttaaagcagtgatttcggaaaaagaaattgtaaataaagaaaagcttatgaatcttcttgcatttaacaaagaagatcttaaactaatgaagcagatgaattatcttactatacaaaatatgagataaagaaggataaaaaagatgacaaagaaacagagaacattggaagtaatagaacgcttaagaaaggaatatccggatgcagactgtactctggattatgatcaggcatggaaacttctggtcagtgtgcgtcttgcggcacagtgtacggatgcaagggtaaatgtagtcgtagaaggtttatttgcaaaatatccgacagtagaggcacttgcagaagcagatgtaaataatatcgaagagattgtacgtccttgtgggcttgggaaaagtaaggcacgggatatcagtgcctgtatgaagatgcttcgggatgagtatggcggaaagattccgaaggattttaatgcgatcttaaagctgccaggtgttgggagaaagagcgcgaacctgatcatgggagatgtatttggtgagcctgcgatcgtaacggatacccattgtatccgtctggtgaaccgtattggactggtagacgggattaaggatccgaagaaagtagagatggaactctggaagctggttccgccggaggaaggaagcgatttctgtcacagactggtgtaccacggaagagaagtttgtacggcaaggacgaagccgcactgtgacagatgctgtctggcggatatctgtaagaaggttggggtagaaaaataaatgcaatatacaattccggattattataaagagttcacctgcatagcagacaaatgtgaagatacctgttgtgcagggtggaagattgtaattgacaaaaaatcactgaataaatataagcatgtgaaaggaaaattccggtttacgatgttgaaatccgtggactggatccgtggcattttcaggcaggataaagaaaagagatgtgcatttttaaatgactgtaatctgtgtgagatgtatgcgaatctcggagagaaaagtctgtgtaaaacctgccgcctgtatccgagacatgtcgaggagtttgaggatgtacgggagattaccctgtcggtatcctgtccggaggtggcaaggattttgatggagaagaaagagccggtccgttttcttacttatgaaaaagaaggagaagaggaatacgaggaatttgatccgtttctgtattctatgcttgtagatgcgagagatgcaatgcttggaattctgcaggagcgggagcattcattaaaaataagagtgggactgattcttggaatggcgcatgatctgcagggcagatttaaccgggaacagttattttcctgcgaggaagtcattgaacgttatcagacaaagagtgccagaaagtttgtacggaaactttggaaagaagaaaagccgtctgtgcaggaaagatgggagatggcgcataagatgttccgggaactttatgaattggaacttctacgtgaggactgggatatgcttctgatggagagcgaagaacttctgtattcacatggagcagatgcgtataaaggaatctcgtctgactttaagcggtgggcgaaggaagagagcaatatccagatccaggcagagcagctgctggtgtatttcattttcacttatttctgtggcgcagtttatgatggaaggatttatgcgaaggtgcagatggcagtaataagtactttccatatttatgagctgtggaaagcacggtggataaaaaatgaaggagagcttacaccagaagagatcgtagagctggtgtaccggtattcgcgggagattgagcattctgataagaatctggagcagatggaaaagatgatgctgcgggacaggctgccgtggtataggggataataaatagatgcctgcacgatttttgatgcatttgaataagaatttttgttaaaaagggcgtatgaaaaatgatttctcatttttcatacgcccttataattttagtctctatgcatagagaacttatccatatcgtaattcttcagattatcaagaattccacgatcgtcagcctgagagatcaaggcatcacggttcttcttggaagtcatctggtcattgaatgaacttggaccgccgacacatccgccgtcacatgccataccttcgatgaagtcttccggaagacgtccaaccttcatgagaaggagggctttcttacattcctgagaaccatttgcacgacagactttcgcatcgatgcagttgtcagattctttcagactttccagaacagctgctgttacaccaccggaatttgcaaagcgttttccgaaggtagaagcggtctggttgtcgttcggacaggcctcgagttcaacgtcttttgctttcatgatcgcacggatctcgctgtatgtaagaacataatctgcatttccttcgatctgctgatcgacaacttcagatttcttagcaaggcaaggtccgataaatacagtgatcgcttccggatcctgtgctttgatcatacgggaaattgcacacatcggagaaacagttgttgaaatattgtcagcaagctgtgggtaatgcaggcgaaccatatttacaaatgcagggcagcaggaggttacttttttctgtccttctttgtaagcttcggcccattcttcagcttcgtaagcagcagtcatatctccaccgagtcctacatcgtagaaatctacgaatccgagctctttcattgctttgcgccagctttccatggtaatgtcagcaccaaactgaccttctgtggcaggagcagccattgcgtagatgtgtttgccttctcttaaagcattgattaccggaacaataaatgttttggaagcaattgcaccgaatggacagctgtggatacatttaccgcagcgtatacatttgtttttgtcgattatggaaatgccatgctcgtcgtaggtgatcgcatcgaccggacaactgaatttacacggacgttttaaatgtgcaatggcattgtacggacaggctttggcgcactgaccacattctttacatttggatgcgtcaatgtgggaacggtaatgtcccggttcaattgctccaaacttacaggcattgatacatgcctttccaagacagttctgacagttctctgttactgtgtagctggagatcggacagtcttcgcaggcagaagaaataacctgaatgatattgccatcatcttccgaacacttacatgagttggactcaagtttaccagtgctgccaattcttcttgtgtaagattcttagcttcccttgcagcttttattctctgaccaaccgcctttaaatccattgtgacacctcctttagaacgataattcggtctaaaattagtataacgattgatctttaaaacatacagaatctacagattgtcaacttgttctttagaactattttaaattaaaaaggcccaaaagggcactttcccttttgagcctatacactttatcagctaacgtattttgctttcattttttctcatggtcatgaggcttttttctcttaaatcgcattctatgaatccttcgattgctctttctgttcttcaataattcgttcggttgctttatgaattctatccttggaatagggtggtcttaaattcaatgataaccgcccttttttaatcatatacgtttcactaccatcctccgaagatcctttcaaccagcaatcatccggatacttctccgcaaaagacctcaaccgtttctgcaagttctgattgaaggtatacacatcatagaatccatcatcttcattagtcagaataatcgtttctttttcacactttaaccttcgcatattctatccccgctttctttccatttcctgatccaggtactttggtatcggctttccggaccggcgagcaatggcaatctgtttctgatgcagtcgtttaatcacggatcttcgtttcttaggtttgccatcctgttgatttctgggagtctgtttgttgctgcgggcatcagagatcttttctggattcttcttctgattatttaccagaccgtccaccatatcataattggcttcggtaccagattctctgcttcgttcataagtgccgttctggtagaatttctggtaatgttccagacgaattttaccatcttgttttagctgttcgaccggatttagcggtacctgctgttggatgtaatcatgaatcttttgttttgtcttttcatcgaatttcttacattcttcgacaaccatttttccataagcatccaggataacaccctgggcctgatctcggtatacctgatgttccatcaaataaaactgttttccatcaataatgatggtgtctgttgcaatccagtttccctttttcccatcaatctgataattctcagtttccatagtgatcagtgcaccggatgtgttgatacgaataaatccggccagatactgtggatagttctcatctacatagtagcagctgatttctccattcttgttcaatacgagcacgtcactgacttcgcattgatttttcgtccgtttccagatgtcagcgattttttcattttcctgcatttcatgaatagagattaatcggtaattttcgacagtaatcgacacattctgctgtcttgcctcttgatatggcagatgccacagtgcttttcctgctgtctgctgatctactcggtagactgcaaattgattaagcttcataggcatcatcctccaagttattcagataataattcagatccagagaatagtagtatttgtcttcgatctgctgtaatttcccaactgtagaattgatgatctcaatcatttcatcattctcaggatcactttcttcctgttccaaaacttccaaagcttctttcagtgtttggattgtttcttcctttgtgtgctgctggaagatagcagtaatagtcagttcgttttcttccaggtttacatttctcataggctcatttccccccttttctttttcggtattggtttcatctgtatattcagctccttctcgtttttttcttcgcttatatttttttcgttatccactttcttattggatttcagtggattttccacatttggatgtctttcttccaagtacttttccacacgactgattgcattttgcacataagaattttctctaaatccaggaatcgaattcaaaaattctttctgtatttttccttcaatcatcagactctgcattccttcataatcacttccgtctttcagatcaaagccaacacatttcagtccatgcatacgttctgatgggattttctcataagcttccaaggcttctggtaatgtcaggtcataatgtacttcacccattacaggaaattcagcacattcagccgcataaaagctgatacatgtaagatcattttcataatccacattttctatttccgggacaatatcgagtattttttctctttgtgctgcaaagtctggaagttctgcaaatccaaatcgatccacgtaatatgcctgcatatccccaccacggtttgtaatgataacatcattgaccgacatagaatgtgctttataatctgccggtggattatcgttgaatacggcatacaaatcatccagcttttcattttcatgtaatctgccagaatagacacatttataatttgctgcatcgattgtaatgccatcttctttgaccattgccatattcataaataaatgttgttttcccggtgtgccttcatccacatggtaaatcgcatagcggtcaccattacctctgaacatttcttcctctagggtataatcaaacttaaatggatacaaagcccgatcaactctctccgaaatatccgttccttctgcaatcgtatcttccagccaatctttgatatctccccatgattcaaactgcaaatacccggcaatttcatgtgtcccatccggtgccagtacaatatgtcccggttcgctttcccgataatcatagcggtatccggctgcttccagtgcatctaccagaatgccgtatttttcatgtaattctgttttctgtttttcttcaagaatgatttccagttcttctgtaagctgatcgatcatttcaccggctgtcttgcggatcacatccatagatgctttcatttccttcatttcccggctgctgctccaacctgcaatataagtctgtcatgttatctggattgaaagtctcatataaaatctgcagtctttccaccccattcaatggatacgccggaactccaaggatcttgaagttgttcaggatatccgactcaatacgttccagttttggctttgcttcccggatattatccgcttcgatggaaaaggtgatatattttgatttcaccagtccattatttcctttcgccagctgctgtttcagcatcttggcatattccatacgtacatcgtcaaaagcatcatcctgaggacggatccggatgacctgttcaaattctttcatgctgcttttatgattgataaagctcagctgaaaatggatactggcatcaaagtaattgaggaaatcgcaccagttttcaaagattgcatttttgtcctcgttctgagccagctgatagttgatgtcatagaagcggatacacttagaatacgtttttccctgtaccctgcagatcccatctcttcccatttccttataagcaatcgactgctggacggacagttttttctgcctgcgtttctcttcctgcttttcttttttctttttctcttttctgtctacttttttgtatccggtatctgcgacagttttcttatttttcttttttcgcaaccgtttttcctcctttcggttttcctgcatccggagactgtctaatctgttccggatctgtctcataatagttttcagtttcatattttctgacggatggacgaagaaacttcacccggatcatatgcatcagaacatcttccagatgcatcccgtctttttcgtacatggcaaataaaaatgccggtaacatcaaaagcaccatgaccgttgctgcattactgtttcccatcacattacgcaagaggaaatagcttggaattcccattgcagcacctataccgatacagatcagctgtcttttggtcaggttaaatgctactttattctttacctttgttaaatctttcggtacgctgacatatgccatgattttcactccttcctgtaatttagtgcgcgttaaatatcgacttacttaaggatgccgtcttaaagaggctgtaacataagatcactgtgtaagccataacgccaaataatgaagaactcagattatctgaatactggatacctgcaacaagcactgcatagattgcaacgcataccatcatcagaaatgcctggaaagccagggcaaagagtcctctgaaataattcgtgccgatctgtccccattctctgttactcatagttgcgaatggaatcggcgcaactgaggtatataggtaaatctctatcatacgtccatacatgatcactgtgatcagtacagacaggatcttcatacagaagccgacgataagggtttccagcgccaatacaacaagttctccgatttccatactttccagtgttgtggaaagatccgtcaatgccgaagaaatatcaatggcggtacttcctgtgataacaccggccgcagaattaactacgtgctgacccacatcgaataccgccattgtgatcgtaaatgtgttactcaccagatacacagcgatccacatttttacgaagtacttgaaaaacatccaggtatcaatatcatgcatgttgttgcgctcggtcagcatagaaatcaattcgtagcagagtacgaatgtgataataatgcctgcgatcggcatgatcacggaatccgataggttccggatcatactgaatatgctgccgttccacccttgcggggtctgtccaacctgggtggcgatctcaccagtcttttgattgacatcagtaaacatcgtgtccaggttggaagtgatcatcccggttaagagttccctcatccattcctcaatcgcatcaaaaatctgactgaacatggatctctactcctttctcttaaccaaataatccactcagaagcgggatcagctgtgttccgatcaggataacaccaccaccgctcatcagctgttttatccccaattaggtgtaaaactctgctcgatggcgggcggcggcgtacaaaaaatctatatggtgtttttaagagaaccgtcccggcgggacaggtcaggcagtgacctgttccacctccgggatgggtttgagattaaaatgaatttcgatagaaatgtgtcttgttttatcttcgtcaatgcgctcatgcacgacgatttctttgattaagcggttgagggtggctgcgtccaactctgtgatgttggcatattcctgaatggcttccacccattgttttgcgtcattggcaagctggacttcatcggacagccgctttctgccctcggacacttttgttttaagttccgtctgctcggtctgtgtcttttccagcatggtgttgaagttctgctcactgatacgccctgcaatcatatcttcataaagccgcattaccattttgtccagaacctcaatccgttcctcgtcccttgtaagggagcgttccattgcttcccgctgttcccgctgctcggcttcacaggtattggtcaggcggtcagcaaccgctttcccgtccatcagggcagctctggcacattcccggattttccgcagcacatgactgtaaagggtgtcataatcaatccggtgctgggtgcagtggttctttccaaaggcattgtaggtcttgcaggagtaaatctgctggggatgttttgcgtttgtgtagcgtaccgtcagagacttcccacactcgccgcattttatcagtccggcaaacaggctgatttcattggtctgccccggacgctggcgggatttcagcttgttctgcacaatgtcaaagctcatgcggtcaatcagcggttcatgctgtccttccactacaatccagtcctccggcttcttttccccaatcgtgccgattttgaaacggtagtcctttttctgggaagcaatcgccccagtgtaaacgggattcatcaaaaggtctttgataacggaaaagtcccacatataccgcccgttttccgggtctttcttttcccatttggtgcgggtattgcgaagcccccgttcccggttccaccatgtggggcaggggattttttcttcctccagccgtctgcggatatagttcggaccatgaccgtttagggcatatccgaaaatcagccgcacaatcggggcggtttcctcgtcaatgagcagatggtttttgtcctccgggtctttccgatacccaaacggggcaagacacccggtaaactgtcctttctgcgctttcagaagataagaggaatggactttcttggaaatatccttgctgtacatctcgttcaggatattcttgaacggggcgatgtcgttgttatcccgcagggtgtcgataccgtcattcatggcgatatagcggacaccgtttcttgggaaaaagtcctcaatcaaatgccctgtttgcaaatagttacgccccagtcggctgaggtctttcgtgatgacaaggttgatttgcctgcgctcaatggctctcaacattctctgtaaatcaggacgctccatattaagacctgtgaagccatcgtcctgatagactgccacaacctcccatccctgcttttcgcagtatttttccagcatatcacgctggtttgcgatactggcactttcgccttgcaggtcatcgtcctttgacagcctgcaatagaccgccgcacgatagcccccggcaagtgctgaaccgattgttctgtattccatttcgttcatcatagccatttacccacacaatccagacggtatctggctctgttgaacctcatcttcattatacttcaaatctttctttttagcaagatattcttttgtatttgttttgccgtatttctgggaaatcaggctgacgaacacatcggtggcgtccagttccccgtcaaatacggttgtcacttcaatcttggtcttatttttcgccataggcagttatcctccatacatgaaaatagccagacagagaacggtcggcaacgaagtccggcaacgggcttcaaaagaccttgcaaacaatctcaatctggcgttgattactatttatacttttcttttatttttctgttgttttggttgtcagagagggaaaaagcccggaaataagggattttccccggcaaccggctcggcaacgggatagcaacgaagtcggcaacgggctgtcattttcagaatggaagctccatctgctctgtgacctccacaaaaccgtccatagatttttcgggcgggttgtcggtgtccgttgccgggatttcacgctcccagcccttttgtctgccgtattccgcaaacatcctcggattggaaaagtagttccacccggtaatgcactggttcattatctcgttgatttcccggatttcccattgcttcggctcatcaaaggtgtggtttaaggcttccttgtagagctgcttggagcagaccgtttccccggtgtacttatcaaggtaagcctgtatcatcccggctttggtgtcctccggcataaaatcccgctggtgttctttgagataccgctgcatggctgggctgaatgacagcttgaacatgccgcttcggtaaatctccattgcttccgcccacatctggctgatataggctctggaagcgacttcgtcctccaaaatgtgaacctcggcttgctccgggtacaccatgaccgggataaatcggcggttgccggaacggtcaagggggagaaagtcaagggcgttggaagtgccgccgaacacgcattgacgggggcggtctgccgggtgagtttcatagggaattttgtaaacctctttctggcggcttagaaaggacttgatttcctcaatgctcttggcattggcggttgccatcatttccgacatttcaattatccagtgaccttgcagcttgcggtacacgttatcatcgtccagcttccgcaaatcatcggaaaaccactcgtcccggactgccagcagccggaagaaggtggatttgccagccccctgaccgcctaccagacacagcatgatttcaaacttgcttccgggcttaaatgcccttgtaatcgcccccagcatgaacagcttcaaggcttcataggtgtaatcgtccacatcagctcccagaaagtgccgcagacagaagcggatgcgctcagtcccgtcccatgcaaggctgttcagaaaatcccggatggggtggtacttattctcattcgccacaatcccgatggcggtttcaatctttttctcactggtaagcccgtaggtttcctccagatagagaagcagatacttcatgtccgtatcggtcagggctgtgctttctctgtgaaaaccgatgggctttatgatgtccttgcggtcggtcaggatgttgtaggcgattgccccggcaagcacagggtcacgctggaatacggtcaggcagttccgtatgctctggcggacgccgcctttctcggtggtttccagagttgcctttacttcctcaacgctctggggcggctgcatggcgttcatggtgttttttagttcttgctgcgtctgcggctgcaagctctgccattcgctgttcaagctgtatcacatcctttccgtagtccataatcaaaaccgctttttcctctgtctccccaaacagcagcacatccagcagatattccacatgggcttgcttctgcaaggcttccacgaaccggggatgaaacgcttcctccggggagtgcggggcatagtcggttttccatacccgtaagaggtgtagataatcggcaaggacacggaagcaatgtgcctttgcttcccggaactgttcttccggggatttctgccggggcttgggcttccttgccctgcccggtggcttccagtcctcataggcaagcccgaagtcactcgccaactgtgcggcggcttcctttttccccagcccgtacagggcagctacaaaatcaatcacatccccatctgcaccacatccgaagcagtggaaacgcttgtccagcttcatgctgggggtcttatcgttgtggaacgggcagcaagccatcccgtttctgtttacccggattccgtaatgctccgcagcctgtcttgtcgtaacggactgcttcacagcttcaaatacattcaaatcaattcctccttgtaaaaaagaaaaggcacttatcattctcaatctgaaaatggcaagtgcctgttaaagttccatatcctgttgtttgtgtttcgtctgcgccggggcgtttttctgtgctttcttctcgtcagccttatcctgcaagacttctttgaggggctgcttcttgggcggctctttgctttcctctgtgccgggtgtggctttccgtacccagtagcggatgtcccgcagcttcttcaaatcttcctgcacctcggtcaacggtactttcaagtctgcgatttcgcccacaagcttcgcctgttcctgcaaaagctcctttttcgtgctgtccttatcatccgggtgcttggcaaggtaggcactggctttctcaaaccgggcaacctccgggtgttccagcttgaatttttccttagttttcttgaaaaatatcttctggtatttctcataaacgggcttacattccttacagtccgtccgggcggcaaggatagcgtcaatcacgttgctgcgggtttcctttggcttcatctgctttcggtagtcggcggcagatttcccggacgtttctataaagttttccaaatcctccacggtggaaagtccctttctctgaagataggacagggcttcgctgactgcctttaagtctttggaagttccacggttttgtcccgcccgtgtccagtcgctccgttctgcctttcgtacctccatgtacttcatcaacagattgggaagaaataccgcttcctccgcagctttttccgcaagcagttcttttcgtttttcactaagctcgataatccagcctttgagatttttaataagctgccggatagacttcatcaggctgttggcggctttgatttcccggttcagatttccgatgttggtctgaatccctcgcttttccatctgccggacagcagcaccctcatggacggtagggataatatcaagcccctgtctttcataagaacggagatccacccgctccgggcggttgttggcttccagatagcggttctggatgatctcccattcatgccgccagatttcacaatacttgcggtcgttccagtcaaccgtatcttccttgtgacttttccatctgccggacggaagttttatccgttccccgttctcgtcaaggtcataaaccttgcggctcttgggaagccatttcccatgttcatccattgcccgcatagtcagcatgacatgagcgtgagggtttccgtcccctttgtcatggatggcaaaatccacgcacattcctttggaaacaaactgctgattgcagaaatcccggacaagggcggcgtactggtcgggcggtatctctctgggaatggaaagcacccaccgccttgcaagctgggagttccattgcttctcaacagcttcggcggcgttccataaggtattgcggtctgcatactctggcggggcatttgccgggagcaggatttcattatggacgataccacgcttttctgggtagtgcttcacttgctggtcgtattcacagaacagcttttcgccgctttggtaagcagcggcggcaacagcagactggcggttgctacgctggacgatggagatttgattgtgtggacagggcatttagtgttcctcctttccgattttaggtataaaaaaagcaggagacctttttcagatttcctgcttggtgtgccgctgggggcggcgggtatttagttaaaattcaagattacttaactttataatagttttctattgcctgtgcaaagaaatcagaagccccttcaccgtatttttcgtctatcattggtttgatttgttcattgcggtaatactgcgcctgtgccatcataaagcctttttcttcttttatctgggcaagctgtttcataacaaagccatattctccaacaagctcttttacttcaaaagaatctatgtcacaattctgttttgcaatcagtttttgcaaaatcgcttctatccgtttgttatagctttctgcaacttctttgctgacgggagttcgggcaacagacagaaacttgtcctttccaccataccattcaactacctttgcatagcctttctgcatttcttccgaagatacgacttccatataatgctttttccattgttcaatgctaccaaattctttaattgcaatgtttctcatattctccggcatatgctcaagcatggtttggaacatttcttctacttctgttttggtaaaaattgtaaaatccattttgttctctcctttcagaatgtcatcaatgctggcaatcagacgttccattcgttctttctttgttaccaacatttttcgctgtacttgtagaatctgatttctttcaagagccggattgtccaaaacagctttgatttctttcaaggagatatcaaactcacggaaaaataaaatctgttgtaatgtttccagtgccttatcgtcataaagccggtatcccgcatcacttttttctgttggctttaacaacccgatttcatcataatagtgaagcgtgcgaacgctgatacctgttaaatctgatatttcttttactgtcctcatagctgctgacctcctgttcctgataaggtaactttaatctatgacgttccgtgagagtcaataggcattttcattttttagtataacatttttcatttcttctcaaaagacagaaaactgattctgtaaaacttgtcggctgggaacagcttgcaacgcaaggtgtccccagatggcaagtccacaaaagggtagctggcgaaagccagcgcaggggaagtgtagcgtcccctgtttgatttggagcagaccgtggctgcggaaaattacagccctccggcgaggagccttcggagaacgcaatgcaccaacctttgggtggtgtataattgcgcccttagtaaactaaggggtttccggcttctcccgttccagcagttttttcaatagttcctgcgtgtcctgcctgtgaaaaatgagtttcaacagcagcatgacatcatcatctgtcaggcgttccggctcttgcagaaaactttccagcataccgccacgagtacagagccggtgcgtccgttcctttcgggtaagctgcttcaactggtgctgcaatgccttttcatcattgatggctttccgcagtttcttttcgcttttttccaactcccggttgagcttttccagttttgaggtatcaggcaagggcagcgtcctcctttcccggtatcagcacataaatcctgtttggttctccaatgccctgacgcacccgcatgataagtccggcggtttccagttcattcagagaacgcttgaccgtcatggggctgcgggacaggactgcggcaatggctgtgatggggaagcagacaaacaggattccgttctcgtcctccttccctttggatagcatagcgtccagcatccggcagtacatgacctttgcggtgctgctgactggaaatcctgtcaacgctctgggaaatggcatacagggcggtaatggtgtgtctatcgtcataaattcaaaattcattcggtgtgttcctcctttttctttgctcgtttggataaataacgggggcagtcaatcacaaccgcccggaagctctgcttgcacccatgctggcatttccggcataattcgttgtaagtgacacgcccccggtcattgaggtaaaaggaaagctcatgcttcctctttttgctcattctcggcatattgtgtttcctcccgttttagtgtatggtttcgggggcgattttcggcaaaattacagccatagagccgcttaaaatctcccgaagtatcagcgatagggtagactatccccctatcagattgtcgtgtttcggtatcatttcggtgtcagttcgccagttctccccggtgtcgttcctcccctgaatctcacagcggcgtatcgctccctttggtacgctcgtttcggtcagggttcctccatatccctgccaaaattcatggcgctacatcgccggggaagcatatcccacacaggctggtcattcgattggaataatccatcgatgaactacctgtatcatagaacatttttgtgccctgtgccgtatgtccacaaagtaggaattaagggtaaaaatcagaaatttccacgattacggaaagtgtgatataatccagataagcggcagcaatgaaaccgttggaaaggagcgtgtgcccatgaaaggagcaacaagcatacaggaacgcctttgggaactccgcaaggacaaaggcttaaatctggaagaactatcaaaactaacgggtatttctaaatcagcccttggcagttatgaaaaagaagattttaaggaaatcaatcatggcaaccttatcacgctggcagacttctatggggtttccgtcgattatctgctgtgccggacagagaacagggagcagatcaacacgccactgacggagctgcatttgaacgatgaaatggttgcacttctgaaaagcggtcggatcaacaaccgtctgctctgcgaacttgccacccataaggactttatcaagtttcttgcggacattgagatttatgtggatgggattgccaccatgcagattcaaaacctcaacacccttgtcgatactgtccgacatgaaatcatagaacggtatcgccctggcgaagatgacccacatttgaaagtgctgcaagccgcccatatcagtgatgatgaatatttcagccacatggttctggatgacctaaacctgattatccgggatattcgggaaacccataaaaaggatagtgagagtgcgccccagaccactgttgccaatgaactgaaagaaaatctggaagcggttgaaaatttcaagggcagccgtttggaaaaactggcagtgctttactgcaagcagctcggtatcaactataaaaatctgtcagatgaagaatttcgctggcttattcggattctccaaaaatcaaagaaaacgggaacgcctatcaaccagaggaaaaaacggtaaaggaaaaccgctgttgcatggtttgttggattccatgtagcagcggtttgtgctgtggttattacttcattcgttttcttaatattcggcgataatttgtttctccctttggtgcgtcctgtataatttccaacacaccatcttcaagcattttatcaatgcgattggaaatccatacatcactaattccaagttgatattttcctaaaacattacctatgacaatagccattttgaattgctctggctgttccgcaatttcacgaagaatgaaactatcatatatatcttctgaaacgctttgcaatttaccatttaacattgcacgcaaaggtgcattttcattttgaagttgattccatttcatagcacaagctgaaagaaatacaggattagctttctcttgtagagttatatagtttccccattcgccaggagagacctcgccccatgctattttggatgtcatagtattttcttttccatattcccatgtaggtaacttaaccaaataaattgttgtctggcagtttaagggttgaagttgtttcataagccaatacataccacaaagctcatctggattatagctataccaaatgcgaatttcttccccagctacatatcgttcaatcactgaggtcaatgtagttttaattttctgtattttttcttcaacctgataatctaaatcctctacaaagcagacagacagcattttcttgaaaacatttttccgctgttcgccaattccattatcagaaatatctcccacactaagagccatatcaaaacaataaacatcacagctcttgcctcccaatggaatagcattctcccaagcaatgcgttcttgttcctgtgcttgaagctgtgcttttttcatttcatctgaagatggaacactcccgtcttcatgcctcataaatattgaaacagcacttcctctatactttcccttgccgtaagtttgggcaattttcaaacttccacaggcactttcaccaaatacaatttcaatcatcttatatacctccgatttaattgctcccgttatgaataaatcatctcatgcaaaacaatttcttctgcccggttatgaatgttattgcaacgctgcacccattccatttggtgggtacgcttcaattcctcggttacgccctcggcagttttcatctgctccatgatggtgtctaaccgttcctgtgcctgttcgttcaggtctgcaagatatgtccacaattccccggtcagtatcaatgtattcaatctggctgggtggacttcccttaaatattcccggtgcatccgtccgtactttccgatagggcggtgttcctccggcagtttcaagtccgggatgtaataatctccgacaaggatataatcaattccgttttccgttattcttggtttcaattcgctcatgttccttacctcctgtggaagcaggctcgtctggtactaactcaatcacatcgcaccctctaaagaagcagttccctgtggagtagattttcctgtttccatgtcaattttgaataaatcaatcaaagtttctgtaacttttggagtgtcagtaacagtcaatgtcgctgtttttccaacttccacatttaaggcatggactgtagaatccagcttgtaaccctttggagcagaaagctctttgatgtaaactgttccggcttttacctcaacttctttggtatcaccgtttccatcggcagtaagtgtggcaagctggctgttacagctcttatcagaatagacaccaaatgtcgcaccctcaaaggaatagctggcgttaccatctgtgaccgttggattggaagaagtctttttgacttttgcatttcccacatttaacttcgcccagaactgtccgatgtcctgtccttcgccagtataaatgtaaccgccacattcatagcgtcctttgttttctttcacaaatgctttcgcaccagtgtacacttcattttgtattgtctgtgagatttcattataagaagctctgacgttgtcacactgccagccgagctgttcactcaatctctgccagacaacacactgttccagcaaatacttctggttgttattcagtcctgtatgagtagcggtatattgcttgacgtactctaatgaaagagcaacgtccgcaatctgatcgctactcatacgggagcttgcgtcagagcgtgttttatagccattcttgaaactggtattgatgtccacgcagtaggcagtttcgccctcaactttcatgtgtccctcattgaatgtagatttgatagaaccatcattcataacgtgttcaatgtagccgacacgttctgctgattctgtccaatattgattgccggaagcatgaaccgccgtcactggtaatgccgtgagaatggttgcaagagcaagtgttcctgtcagcaatcgctttactagcttattcatatttcttctttctcctttcgattttgggtatgaaaaaagccgtccatttctgaacgactggaaatagaaaaggaacgccaaaagtgtacgttccatagtctataaaatatttaatttttctctctggtgtgctatctgacgccaattttgaccccaaatttctgaaaaatgacgatttttgatgaacagctacaaattttcaaaatccgtgaaacccttgtaactagggcgttacgggactatatgaaactagacaaaaccaacgtcacaataacaataggtgagtgctaattattttgtgaagattttgtgaacgaacttgcaaaggcgtctatttttgctattttatagggcgacagcccggcaacgaggaaattctttctcgagctgtgcatggcgtatctctcagcttcccagggatttttcacttgctttcgcactcgattttcttgatttgaccacatttttacgacaaatcttcggaaaaatatattcgtctgattttcttactacacttctccagcaatatcatattttctgacaaaattttgtactttgttccactcttttctaactgtgctttatacttttcacactcctgtacaatcgctttttttgcatactctgtcgtttctccatcatgatttgaaaaaacaatgtctaagtgatacaagctgctttaattcttttcattgtaactacatctctttcaatttaaagatacgtcacatagaaaaagggatccttcactcagtaaatttgaatgaaatgatccctaattttcatgtaaatcgtacttggttttacaatactaattatactttattttttgaaaaatgtaagcaaatttttattttgcacactcaataattatcgcttcacatctgtcatatccaagctgtgagctgttcagacacagcgtataattgctcgtttttccccatttctgatccgtataaaaattataattcgtcatacgccttttatctgtatctgccatcattttgacagcttccttttcttctacattatataaccccataattcgctttgttttttccggcatatccccatagataaatacattcagcacatcgtccctatccttcagaatatagtctgcatttcttccgataatcacacaagattccttatcagccagttctaagataacctttctctgtgcctcatacaccatgtcttctactgattttcctgtaatatcacgtccggcaaatgcatatgcaaataatccttttttcggagataattctgcatttttctgaacatactccggtgacaaaccggacttctctgcaatgtcattaataatatttttatcataataagcaatcccaagtttcttcgctactttttctccgatgaaacgtccaccgcttccaaattctctactgattgtaataattcttttcgccatctctgattcctccttaattcaaaacatctactttattttttctgattctctttaaaaatacataacctgcaaaacatgaaactatttcagtaatcggaaatgaccaccagattaatgaaatgcccatctgtccatttctgacaaacatagaaaaaattccggccagcggcagtataataatgagctgtctcaaaagcgaaataacaagggactctataccaccattcagtgcctgataaataccctgataagcaatattgatgcctgcaaacaaaaagctgactgagattattctcattgcttcaataaaatattctcttgactgtcccgcattaaacagcgttgcaaatactccggggaaaatctctgtgattgtaattcccagaatcattaacacaattatatagatcagaccatatttgattccatcctgaattctctttttacttctcattccataagcaaatgcaatgatcggggtgatcgcatctcgcagaccaaaagcgagaaacagtacaaactgctgaactttataaaataatccataggctgtctgtgctgctggattgaacttcaggatcagattcatcacataaaccataatggacatcaatgcctgtgcaatgattgccggaagtccgattttatagatttctttgataattccgccatccggcttcatgtattttgccccatgctcgaattccttattgaatttgatatgaaagataagcaataatactgcggatgctacctgaccaattacagttgcataagctgcacctttcactcccatttccgggcaaggaccaataccataaatcatgatcggatcaaggataatatttacaacggctccaaccacctgaccaattgtggaataaagagaacgacctgttgcctgtaataacttttcaaataaagaaaagaaaataataccaaaagagattacgcagcatatcctcagatagctgactcccatctccaatacttctgtatctactgtctgtgatgaaatatatgctttcaccccaaagataccaaacagtaagcagaccacataaatgatcactccaagaaacagactgtttcctgctacctttgctgcttttttactattcccttgaccaagtgtccttgccagaagtgcattggttccgacacccgttccgattcctactgcgaccataagcatctgaaccgggaataccaaagtcaatgcatttaatgctgcctcactgcctactctcatatttcctacaaatgcactgtctacaatgttatagactgcctgcaatgccatagataggatcatcgggattcccatctggaccatcagcttatttaccggcatctccttcatcttgttgctttccgccattttttaaactcctttctttttggcacaaaaaaagtgcgcaccttgtcatataagctggacttacgctgacacgctacacactttttcatggcgatattgatttttgcaaaatgaaaacgagtagctggtaaactggatttacgcttacttgctactcgtttcttgtaattatatttcctctttttcaaaaagtcaaacaaaattttccttacattctctcttctttttacgcataacaaaagcgggtgatgggaatcgaacccacgtatccagcttggaaggctggtgttctaccattgaactacacccgcgtcttaaagacaaataatatgatatcacatctcagaaaaaatgcaagccttttttttattttttgatcacttttattactttttgtccactttattttctgaccgctattttatctatttcggttcttttccttccatttccacatatattttatcaatcacctgttttctatccgatcggagttccttttatgttttccagattaaaatcaaaaaatattatacggatctgttttcttttccttgcggctttctttgtgggaaccggcgctgcatttctgcatgatcatttctttccagccgctgttcccacctcttctgaaggcaactggggactcagcttccaaacggatggggatccccctgtcggcaatgccacatttgacgagttgaaaaaatttgatgccttttacgcacaggacaccggcgaaaaggtaatctaccttactttcgatgccggttatgaaaatggaaatacaccggctattctggaagctcttacgaaacatcaggctccggcaacgttcttcgtcgtcggcacacttctggaaagcaatccagaacttatcaaacagatcctcgctgccggtaacaccatcggcaaccacacctggcatcacaaagacatgtcacagatttctacaatggaatccttttctgaagaaatccagacagttgaaaaactgtatcagcagatcaccggacaggaaatttccagattttatcgtccaccacaaggcaaatacagcgaagccaacctgaaaatggcacaggatcttggctatcataccttcttctggagtctcgcctacgtcgactggtatcaggatagccagccatcccacgaagaggcttttgaaaagctgcttgggaggatccatcccggtgccatcgttttactccacagtacatcctctacaaacgctgaaatcttagatgaacttctcaccaaatgggaagaaatgggttatcattttgcttctcttgatgaccttataaaagctactgcatcttaggaatttttctctgtcactttatcgaaggattctctaatcgatcagtccatatttcttcatcgcataagcaattccatcttcttcaacggtctttgtaacaaattctgtataaggttccagcacctggtcatgcgcgcccatcgcaatcgcatgcccggcatgccggaacattgccagatcattgctgctgtctccaaatgcatatgactgatctctcgtcattccaaaatgctccagtacccagtcaatcgcagttccttttgtatagcccttgaggatacattcaaacgtattacttccacggtcgattacttccatatcatctttgataaattcaaaaaatgcttttacatcacttttttcatccgtataaataaagattttatcatatggacatcttctctgctccatataacgctcgattccaagtccacggttattcatgtgtttttttgtattttccaatctgtcaaatcttgaaactcttgaagtgaaatacacatcttctgctccctcaaaaatcccatcaatctgacattttgtcatataatcagcgatctcatcgcccctctccggatccagatgcttttcaaaaataatttcttcatcaaatgtaaaataaatcccacatccacacaaatatccatcaaatggaagttttttcagttccaccggaacactgcagtatgttcttcctgtattgataaataaaaaatgtcctgcgtcgtgtgcccttttaagtgcatctaccgtacttgcgggaatctcttttgtaatctcactgagtacggtcccatcaatatcaaaaaataatgctgctctattcattctaccttttcctcccggttatactccaattacacgatactcattatactcatatttcaccattatgcgcaaccctttttcattttctgcaaaatatctgtgataaataccattttgacttctccatataaaagtaatataatagatgttgtacaatttgaaaaaggggtaataataatgaataaaagaatcgataagaaaaaacagaaaagaacacttgaatcagcagtaactgctacagctacatcatcagcaccggctacagcaactcctgttgtagagataaaagaagttgtaaaagaagtcaaagtaccagtagaagttcctgccaaaaatcctgcattttatgttcagtaccagagtgcagaatatactgtagccgctatcacagaacgtgtgatcgctgactgcaatgcaaagggacacgctgtagaaaatccggaagctctctccatttatctgaaaccagaagataaaaaagcatattacacccttggagggttcaatggatatattgaattataaaggagtattttatggcgcttaactttcaacagcttggaatgcttgcaaaactgaaatccgcattttccacttttcaacagcagcatcctaaatttatgccttttattcatgcagtaaaaggagatgcatgccgcaaagacagcatcatcgaaatctccgtcaaatctccggaaggacggaattataccactaatttccgtgttaccgaaaaggatttggaacttatccagatgctgaaagatatgcaggaaaaccaataaagtatacaaaagcaggtaagaaaggatagaatttcttacctgctctttttttatcttactttagcatttctttgctaatgcaaaggaatggccttccatttttattgcctgaaggctgacttttttaccggtatataaatccatatactctccctcttcttcgatccaggctgtccggtcctcttctgcgaaattaaaaagtgctgtcatctgctcgccctccagttcccgcacaactccaaggattccattttcccaggtatcaagcgtccagacatttgccgatgcgtcaaatactttttccttacttcggatggatctaagttttccaattccatcaaacagttctttttgtaccgttccttttctctttcgtccgtctgccagcttccagtcaaattttcctctgtggatatacctggaatcaacccgtttttccggatcatttttataagtataatcatttacctgaccaatctcatctccactgtaaagcattggaattccggattgcaccatcatatatgcatgcagcatcagatcaaatctgactgctctttttttcttttcttcattttgttcaaatccggcactttcaattccacacatggaagctgtcgttgcacagaatctggcatctcctgttatcggatcttcattataaagtttcccgcggctcacactttctgcgatctttcccgtgaagaagtcattcagatatcttttgtgtgggacttcctgcattccccaaccagaaagagtctggaaatccaatccccatccgatatcatcatgacatctgaggtaatttaagaaagtatactctttcggaaggttgttcataatatcaagctgcatccgtaaaagtctggtatctctcgtcgcaaccgtattccatgtagtagccatcatggttacattataaagcatatgacattccggcttttctatggtaccaaaataaggaactactttttccggttccatcacgacttcccctaataatacaaccgacggacacacaatctccccgatcatacgcatcatcctgactatcgtgtgtacctgtggaagatttctgcagcttgtccccatttccttccagatataaggaactgcatcgatccgcagaatgtcaatcccctgattgaccaggaaaaggaaattatacatcatttcgttaaacaccctcggattcttataattcagatcccactggtaaggataaaaggtagtcaacacgtagtgtccgatttcaggaagccaggtgaaatttcccggtgcagtttctggaaatacctgtggcactgttttctcatattctctgacatggttttcattgtcacagaaaaaataccggctcatatattcgccttcacccattcttgccttctgtgcccattcatgatcttcggaagtatggttcattacaaaatccatacacagattcatgtctttttcgtggcaggcttcagccagatctgcaaggtcttctatggttccaagttccggctttacttttctgaaattcgcaaccgcatagcctccatcggatcttccctttggcgaatcgagaaacggcatcagatgaacacagtttacaccacattcttccagatacttaagctttcctttgactcctcttaaatttccggcgaaattatcaatatacagcatcattccaagcatgtttttttttcgataccacgcctgatccttttccttctccagatctctctttcgaagtttcgtatttcttgcatgatagtaattctgcatctgttcacagagctctgcaaacattgcttcattatcatataattccatatagagccagcgaagctcatccatatgcttcgccagtctcttttcaaaaatatcatttgtttttctcatttttactcgaccatttccagataaatctgatatgctttgtactcaccaaattcaagcggcatcggaattccaacttccatcagcgcctctgccggataaatttttccggtatttgaatctttatagaattgtccggcacacagacctttcatttttacataatttactgtcatgtttccatggatttcaagcataactacatttacaagtacttctttcccatcttctgatacaaattcccatgcgccgatttcttctgcgaatggattactcagtcgatagtaaagtccattttgtacaagctgtgcatattttttgtattctactatctgttccctgatctctctgcgctcttcatctgtcattttcgccggatccagttcataaccgaaggttcctgccatggcacagacacctcttgtatggagcgatgtctttcttcctgtctgatgattcggaactgcagatacgtgagatccaactgcagataccggatacccaaaggatgttccgtattggatccttacacgatccactgcatcggtattgtcactgcaccagatctgtggtgtataatacagcattcccgcgtcaaaacgacctccaccaccactgcagccttcgatcagaaggtctggatagcggcttataatacgctccaggaaatcataaagtccaagcatatagtcatactgcacactgccctgttcttctgctgtcatagaatatacttctgccatacttcggttcatatcccattttacatattcgatatttccctgatcgagcacctgacacatctgctcataaacagcatccacaacttcttttctcgaaaaatcaaggagcagctggtttcttccttttaccggttttcttcccgggatctgaattgcccagtccggatgttcacggtaaagatcactgtcttcatttaccatctccggctcaaaccagagcccgaatttaacacctaacgcattgatcctgctgatcaggtcaccaagacttccctgcagcttttcttcattaaccttccagtcgccaagtccactattgtcatcatttcgacttccaaaccatccatcgtccagtacaaccatatcgattcccagatcctttgcctgctcggcaagatgatagatgtcttctcccgtaaaatcaaaatagcatgcttcccaactgttgatcagtaccggtcttactttttctttatattttccgcgacacagatttttacggatacatctctgcagattctgggaaagcttttcaagtccctgattgctgcaagttaaaataacttcagggatcacaaattcctctccttttttcagtggataaaaaaactgttcttcctgcagtcccatctgcattcttgtctgcccgaactgatccttttctacttctgctttaaatcctccgctgtatacaaaagacattccataacagataccggcatcttctgtcgtttctttttctgccagtatcagcatcggattgtactgatggctggatgttcctctgcggcttccaattacaaaagctccatgtcctaccgatgttctttgcatatttctttccatcgcatggcggccgtaaaatgaaatcacatcaaactcaccgtgaaggaaatcaatacaggctgcctgtgcttttgtcagtctgattttatcttcttctgtattgatcacttttgcacttcttgtgatcacatcatactccggaagaactccataaagtaattctacctgtaatcctgtcacctgatctttcatataaatgatcagagtctgggcttcctcttcagcagcataaactgccggaagtcccttcaaattgtattttccatcacaaatctcatatccctgatatctaagatcgcatccaaaagaaccatctgcatttacaagatcaagcaccggactcctgaaatctcctgtcaggcggcatggaaattcctgcggcagcacatcaagggaatatgttctgtcatttcctgtatcctgcggatttcctgagaagccacggtctgcataggtcagaagatagtccataactccatctgtctttcttccataatataaatgcagtaaaaatccatatgcatcaatttgcatctgatacgttgtattttgggtatgtaatgtaaatgtttttgctttctcgttgtatatgattcccatattcttctccttaagcttctgtcaaatttattttactgcgccatttacaacaccgttcagaatctgtttctgacagatcagatagaaaatcaaaatcggaagcagtgccagtaaataggatgcaaatgcaagattataattggttccaaattgtgtctggaatgtcatctgtgcaagtggcagtgtgttcacatcactacctgccagaattacaagtggtgtcataacatcattccatgtaccaagtgctgtaagtaccgctactgttgcatgcatcggtttcatgattgggaaaataacgctccagtaagttttccaggttgttgccccgtctacatgtgcagcctcttccagtgccatcggaatatttttcagataaccggagtataagagcacattcatcggcatataaaatacaagataacacaaaataacaccgaaaatattgtcaattctcatctgtgctgtctgcttcacaagtggcatcatcaaaattgcaaatggaacaaacataccgcttacaatataaagataggctactttgtaaaatttactggtacttttacttcttccgatcacataaccgatcatagaatgaatcagaatggaaagaactaccgttacaatcgttatcagcacactgttgcccagtgaatgccagaaatctgttacacgcattgcttctgcaaagttagaaaagctccagctttttggcagtgataagattccggaaatactgtttgtcatttccgacggtttcttaaatgcaatcacaactgtaagataaagaggaaaaataacggttacaagacccagaatcaataaaattgtgattggccagtttactctttctttcacctttactttcattataactgttcctccttatttcccaaaaagttcatctgtaatacagagatcacaacgatcactacaaagaacacaactgcattggcactctggaacccaaactgtcctccggccataccattgttataaatcaaaaatgaaattgattctgtactctgcgccggacctcctttggtaagagccatgatctgatcaaataccatcagaaaattcttcatgcaaagtaccatattgatggtaaagaatggaaggatcagtggaaatgtcagattcttgaattttttccatccggtcgctccatcaagagaacctgcttcgtatacatcctccggtaccgtctgaagtccggaaatataaataatcgtattcattgcaacagactgccatgcacatacaattacgatcgcaacccatgcccattttgagcttgccaggatactgtcaccttttccgcccatcatttttacaactgccggaagaatataagtgaaaaagtaattgaaaatatagcccactacaagtgctcctaaaatatttggaacgaaatacattcctctgagtgcacttttaaatttaattttactgtttaatccaagagctaaaacaagacttaacacatttacaactattgttgcaacaattgcaagcttgaatgtaaacaggtaggatttcccaactcttgcatcagtaaataagtctgtataatttcgaatacctacccagtcaaactcgccatatcctcgaaaatttgtaaaactataaataacacctttaataagtggcagcgtattaaagcagaaaaacaacgcaagtatcggtatcgtaatcagtaaaaatgtccgctctctgccattcatccttttcaatttattcatgatctgtatccctcctacttgcctgcttcataatcttccatcatacgaatgatatccctgttatatctgatccagtctttgtcaaattttttcaggaatgcgtcaacatcctggtttatgagaaatgtctggatttgtgcatcgactgccatttctgacggataatagtgatcctggtaatccgccatacggttatcctgaatatatggtttcatatcttccagctccggagccagtgcaaaatcttcatctttacaaggcactgcattctgcgcatctaagtatgcctggatactttcatgatccatcagaaaatcaaggacttcatatgccgcttctttattttcacatgcatccatcacgcagaactgcaaatctactcctgaatttaatacattgtcctcttcagaatcattagccggcataacaaaggatccgatattcatatccggatttacagatttgatctgcggaattgcatagcttccgattgtatacatcgctgattcaccatttgcaaatgcagtacatgcatcgttgtatccgtatccaaacggtccatcttcaccataatttaacaattcaagcattttttctgccacttgcggatattctttggagaaggttgtttctcccttattcacctgctgacaaacatcggatggtgcaagtccgactgcaagtgcattccaaggtgcaaggcaggtccaggtatctttatatccaaaataaagtggctggattccttcattctgaatctcctcgcaaagagaaataaattcatcccaggtctgcggaatctcccatccatgttccgcaaacatatctttgttatagagcactcctgccgcatttgccacatacggaagcccatatgttccttctgtcggaacaaactccaatccttcaataatatccagataagcaggttttacttcactaagtccttcataatctgaaaggtcagccagtattcctgaatcaacaaaatacgaataattgatatctcctccgattccgataatatccggataatcttctctgataaaacgtgttttcaaaattgttgtcgcatcatttggggaagatatttttaaatggatatcatcatgtgtctcattaaattctttttcgagctgttcaaatatatctaccgcctccggtttatactgaacaagttcaatttccacttttccgctttttggattttgctgacatccctgtaatactgctgatgccatcagaatacaggacattcccaaaacaattgctgctcttttccttctcattttttctccttcctcacaggtatattcgtttttagttaccgctcgatatatcaagtactttgtttatatttgcattataacataccattatgcgactataaatatcattgtatttgaatttttattccaaaatgctattattttcttcttttttgctaaatgtatagcattttggtatattttagttgcaatctatttattaaatcagtagaatgaatatatatatcaactgacttaacatctgctaaacatcatttttcacggcagagcacctatgagaaaggaattattatgaaagaacttatgttttcagtatttccaagcgagaattttgtcgatcttggattgtatcagtttggttacgaacaatgtgaaccggcgcatagttttggtcctgccgtccgtaatcattttctttttcactacattatctccggcaccggaattttaatggcaaatgattctcacggtgtcacacagacctatcacgtaaaaagtggccagggctttatgattttccccggtcagatcaatacttatatctctgatgaaaaactcccatgggaatatacatggattgaatttgacggactacgtgcaaaggaaaccattgaactttccggacttagtttggataatccgatttataaagctacttctaaggatctgcgtgaaatactgaaagaagaacttctctatattgcaagtcacggagacgctacaccatttcacctgatcgggcatctctatcttgcaattgatgctcttattcgttctacttccatcatgcagacatcaaaaatcagccgtcttcaggatttttatatccatgaagccctatcttatatagagcagaatttccaaaacgatatttctgtcgaaaacatcgctgctgtatgcggattaaaccgcagttatttcggaaaaatattcaaagacggaattggaaaatctcctcaggaatttttgttgaattatagaatgattaaagctgctgaattattaaaactgacaaagctttccattaaagatgtaggtaatgcagtcggttatcccaaccaattacatttttccagagcatttaaaaatatttatggaatatcgccaagagactggcgtaatcagaacagacttaaacaataatagaaaaagaatgctgcagttcagactgtgcattctatttttattatttaatatgtaataataaagaatgtgcctaggctcgtagtgccttttatttaacaggaagttcctacggattttgctatgcaataaaaaaactgcaaacccttacggtctacagctcccttactttttacatgtaccttcaaaaccacatacaaatctaaatctttactccatccattcttccttaccctgtcctaccttcttggttatgccctcgaccgattagtaacagtcagctccatgcattactgcacttccacccccctcgccgggaccggaatgggtcacataggaaagctggtgcggggagattcccagctgctttgccaaaatctgacggtctcccttggcctggttgagcatatagataaagtccgagttctcaaaaatgttctcgatctcacgggaagccagaaggtccttgacgttctgcgttaaacctgatgggattccgccccatttacgaaagcgtttccagatctccacgctgaaacttcctgtctgccctttcaaaagaaggtggaattcgtcgatatagaaccaggttgttttatgtttggaacggttggccgtaacacggttccacaccgcatcctgcatgatcaaaagcccgatttcctttaaggcttttcccagtgatttaagctggaaacacagtacccggtgttgatccatttggatattggaacggtggttgaacacgttaagggaaccattgacatagatttccagcgcagttgcgatattctgtgcctccggttcagactgtttcaaaagcagctcgtaaagatcgcctaagatcggcatattttccgggcatgggtcctgcaggtattcccggtacaccagtctggtacaacggtcgatgatcgtcctttcaataggggaaagcccttctttgccgccgatgataaggtcacacagcgacagaataaaatcacttttcaaagtgatcgggttttcatcatcggaatagtccagattgatgtccatagggttaatgtagtttgtggaagtaggggaaatatcaatgacctgcccctgggaaccgaactgctgcaccagcggcccatactcattttccgggtcagcgataatgatgtcgtcctccgtcagaaggaacacattgacgatctcacgcttggcagagaaagatttaccgcttcctggggtaccgagaaacagcccattggggtttttcagcgtttttctgttcgccatgatcaagttattggaaagggcgttcaggccgtaatacaacgcctcgccctcctggaacaattcacaggtggtaaacggtacaaagatcgctgtgctgctggtcgtaagcccgcgctcaatttcaatctggttcgtaccaagagcaagcgaggacataagcccctgttcctgctggtaatccagccgttttaaggcacagttgtatttctgtgccacacccgaagcggcaaaaatatcattgaacagcttttggcgtttggcagcgatattttccaccagtaccgtcacaaggaacatgcgctcattgcggctctgtaaatcctgcaaaagattttttgcttcctctccataggtggcaaggtcggtgggaatgatgtccatatcatacccggatcggaccgctttcttttgttcctcaatggtcattttctgcaggtccgacattttacgcttgatgtttcggattgcctgtgcctggtcgatagactgaatatgcaagttgacagtcacggcgtcgtttaagtcaagaagatccgctaaaagccggtcagtaagctccggcgccaaaatctgcaaaaaggagacggcaccggaatggtcgcctacccggaatgtctttccatcctttgaaaaagacagcccggatggggaaatgaagtctttggtagaaagaccggtcttaggcagatccgaccactggaaatgaaacttttcctgaccgtccgggtgaagctggccgtgaagaagttccagacgttccagtccgtttaaggatcttgactggactccaagggttttgaaatttgccagcacatccgtttcaatgcgttccagacgcattttcgcagtacgcaggtcatctgcctcgatcccaaaggtaatgtatttgcgtttggtgagaccgttatttcctttctgcaactggttctttaacatatccccgtattccttgcggattccgtcatactcgtcgccgcggggagggatttcaatgcttctggtaaaatcctgcatattggcccgctggttgataaaggtaagctgcacatggatcgaagcatcgaagtaatttaagaaatcgcagtaaccctcgaagatctgtgctttatcatctgcctgtgcaagctgatagttaatatcaaaaaactgtaccgttttggtgtaaagggtatcggtcaaccggcagatcccatcccggtacatttcacggtagggaatgctctgctggaccgtctgcggggcatctgctttcagcccggcaaaaaagccgccttttttagacggcttggaacgggcagacttagttttgccctgctttgcaacggctctggtctttttggcctgcctgatatttttttgcagacgcttttcctgagcttcctgctgcttgttttttggcaatctttgtaacctccttctttgacatagatttatacaggttatccgtcctgtatggacggttcttcggccagagcttataacggagccggttcttcaagatcttttctgccggctgtccgtcacgctcatacatggcgaagaagaaaaagggcatcatcagcccgatcatcaaaagtacagccgccgaattgccgatcgccccgcgggtaaagaaatacaccggaaggccgacaagcccggcaagactgaaacaaataagctggcgcttcgtcagattgaaggccagcttggttttaactttggttaaatcctttggtacaggtacataaggcatctatacacctcccatcgtaatatagtttccggcccattaccgtgcaccgaattcgcgtaccggtttctccgaagccggacattcccgcacttcctgagccgcattttgcagccgtgccaggacagaaacagccggtcctctctgacacaggtattcctggctatctcggattccggcaatattttcccgaatatccatatccacgtcgaacacatccgaaaccggtaaaagccaacggtctgcaaagtatttcaaaggattctcaagcgccagcacatcatccaacatttcatccccgaactcaaactttgttgtcagataggaatacgcctcctgcatggctgtaatttcagcagctttttcaattaaggattccttatctcttgacataaggctttcccggtaagcaaagtaattctgtcccagccgtttcatcaggagtgtatatttgtcctgtgcggaagcttcgcttgtgaaatgttcaaatttttgctctgcatcaatttctttgagaagatcgcagatcgggaaactgtgttcatggttattttcttcccaacaccatcgggctacatccaacgggtcctgaaaagaaagaagcgcctctacttccgccggagtaaatacatgctcaaccttcagataatagtggagttccgaaagtccctgtaactcgtaaatactgccgatgttctgtgcatccagcatatccgcatgaaccttcaaacactcgtccaaccgttccataagcagcggctttgcatcttgttctatcaaaatcacccctttcgctccggcatagtcagcgtacagttcacttcattgccccatacatcccagccgggtgtcttttgtcttgcaaacagttccactctgggctgatcgcccatgagttttacgatcttatcccgcacctcgtccggtttcttgctgtgctgctcaatatgggagatcacaaactgatggattcccgcacactggcgtttcggtcggcctctggttgccagcaggcagacctccgcattggatcgggtccaaaagcccatgccataaaaccagctatccgctttccggttctgtttgagccatagaaaagccagcgttttatatttgaacccccaggcgtcgatcacccggaaggcttcattgagctgtgggaaggtcgcccacagaaagagagcgctgtcttttgcggcaagttccgataccggcagggcacagatttcttcaatgctcatcgtggggtaatggttttccgcaacgccgcttccatgtttcctatcatagcgccagggcggatcggcatagataatgccgtactgtttcgtttccggcattagcgagcctgctcattcttagatggggcaggtttggccggctgttctttgaccttaccggcattttccttcaatgcaccggtcagggaaggtttttccgcagctccctttgttgcttcaagagttgcttgcaaattttcaatagcctgcccatacccatcgatcagagcgtcattaagctgtttgcggaactctgccgtaaccggccagcagacatctttccagttgcctcccttatcctgggttgcgggcatattgacatacagccccttttcactggaacagatacggaagccgtcaatcttaaagcatccgccaatcgtaacattggcaaacgccagcaggtttcccattggggcgatcggacgcacgcggacatccagcttcatgccgtttgtcatttccggcgtctgtgtctccggcgccattttttctgtattggttttactcatatataaaatcctcctttttagaattggttttgttcatgctatcttgcattaaatatggatttggataacgaacctgtcttaaacagggcaaaggccagcagtaccgtataacccgccgttccccagatcgcgccgtgcacgtcgccggacgatgggatagactggaccagcactgcataaatggcaacacagatcaggatcaaaaaaccctgaaaacccagggcaaaaagggaacgcagatacccggttcccatttgtccccattcccggtttgccattgtggaaaacgggatcggtgcaaggctcacggttaaataaatctcgatcatacggccatatacaatgacaaagatcacgatggacagtacccacatacacagattgatgatgttggtttccagccacagtccaatcagttcccacattcccattgcttcaagctgggtttccagatcagacaacgccgcctgcacatccaggttcccgtttatgacaccggcactttgcgacaccacattttgggccacatcaaagaccgccatcacaatcgtaaaacagttggtgagcaggtaagtggcaacaaaagtcttgaaaatccacttgaagatgttgaatgtatcgaattcgtgcatgttgttcttttcgagaatcatctggatcagttcatacaccagaacaaaggtcaggatcatgcccgcaatgggaatgacgacggtttccgaaagattttggatcatggaaaatacgccgccattccagccctgcggggtctgtcctacctgatttgccacatccgcaacctggttgttgacggagttgaaaatactggtgtactgtccggtgatcgcatcgatcaggccctctttaatccagtctgttatccattcaaacagactgcccataagtcagcccttaaccgaacaggccggaaagcagcgggatcagcgttgcaccaaccagagcgatacctccgcctgccataagctgttttatccccaattaggtgtaaaactctgctcgatggcgggcggcggcgtacaaaaaatctatatggtgttttttagagaaccgtcccggcgggacaggtcaggcagtgacctgttccacctccgggatgggtttgagattaaaatgaatttcgatagaaatgtgtcttgttttatcttcgtcaatgcgttcatgcacgacgatttctttgattaagcggttaagggtggctgcgtccagctctgtgatgttggcatattcctgaatggcttccacccattgttttgcgtcattggcaagctggacttcatcagacagccgctttctgccctcggacacttttgctttaagctccgtctgctcggtctgtgtcttttccagcatggtgttgaaattctgctcactgatacgccctgcaatcatatcctcataaagccgcatgaccattttgtccagaacctcaatccgttcctcgtcccttgtaagggagcgttccattgcttcccgctgttcccgctgctctgcttcacaggtattggtcaggcggtcggcaaccgcttccccgtccatcagggcagctctggcacattcccggattttccgcagcacatggctgtaaagggtgtcatagtcaatccggtgctgggtgcagtggttctttccaaaggcgttgtaggtcttgcaggaataaatccgctggggatgttttgcgtttgtgtagcgtaccgtcagcgacttcccacactcgccgcattttaacaatccggcaaacaggctgatttcatcggtctgccccggacgctggcgggatttcagcttgttctgcacaatgtcaaagctcatgcggtcaatcagcggttcatgctgtccctccaccacaatccagtcctccggcttcttttccccaattgtgccgattttgaaacggtagtcttttttctgggaagcaatcgcaccggtgtagacgggattcatcaaaaggtctttgataacggagaagtcccacatataccgcccgttttccgggtctttcttttcccatttggttcgggtgttgcgaagcccccgttcccggttccaccatgtggggcaggggattttttcttcctccagccgtctgcagatatagttcggaccatgaccgttcagggcatatccgaaaatcagccgcacaatcggggcggtttcctcgtcaatgagcagatggtttttgtcctccgggtctttccgatacccaaacggggcaagacacccggtaaactgtcctttctgcgctttcagaagataagaggaatggactttcttggaaatatccttgctgtacatctcattcaggatattcttgaacggggcgatgtcgttgttatcccgcagggtgtcgataccgtcattcatggcaatatagcggacaccgtttcttggaaaaaagtcctcaatcaaatgcccggtttgcagatagttccgccccagtcggctgaggtctttcgtgatgacaaggttgatttgcctgcgctcaatagctctcaacatcctctgtaaatcaggacgctccatattaagacctgtgaagccatcgtcctgatagactgccacaacctcccatccctgcttttcgcagtatttttccagcatatcccgctggttggcgatactggcactttcgccttgcaggtcatcgtcctttgacagcctgcaatagaccgccgcacgatagcccccggcaagtgccgaaccgattgttctgtattccatttcgttcatcatagccatttacccacacaatccagacggtatctggctcttttgaacctcatcttcattatagcctatatctttctttttagcaagatattcttttgtatttattttaccgtatttctgggaaatcaggctgacgaacacatcggttgcgtccagttccccgtcaaatacagtggtcacatgaatctctgttttgttttttgccataggcagttatcctccatacatgaaaatagccagacagagggtgtcggcaacgaagtccggcaacgggcttcaaaagaccttgcaaacaatctcaatctggcgatggttactatttatacttttcttttatttttctgttgttttggttgttataagggagaaaagcccggaaataaggggttttccccggcaaccggctcggcaacgggatagcaacagggggtgcaacgggcggtcattttcagaatggaagctccatctgttctgtgacctccacaaaaccatccatcgttttttcagacgggttgccggagtccgttgccgggttttcacgctcccagcccttttgtctgccatattcggaaaacattcttgggttcgggaagtaccgccagccggtaatgcactggttcataatctcgttgatttcccggatttcccattgcttcggctcgtcaaaggtgtggttcaaggcttccttgtaaagctgcttggaacagaccatgctcccggtgtacttatcaagatacgcctgtatcattccggctttggtgtcctccggcataaaatcccgctggtgttctttgagataccgctgcatggtggggctgaaagccagcttgaacctgccgcttcggtaaatctccatagcttctgcccacatctgctcgatataggctctggaagcggcttcgtcctccaaaatgtgaacctccgcctgctccgggtacaccatgaccgggataaaacggcggttgcctgaacggtcaaggggcaggaagtcaagggcattggaagtgccgccaaacacgcactgacgggggcggtctgccgggtgggtttcatagggtatcttgtaaacctctttctgccggcttaaaaacgacttgatttcctcaatgctcttggcgttggcggttgccatcatttccgacatttcgataatccagtgaccttgcagcttacggtacacattgtcatcgtccagcttccgcaaatcatcggagaaccactcgtcccggactgccagcagacggaagaaggtggacttgccagccccctgaccgcctaccaggcagagcatgatttcaaacttgcaccccggctgaaaggctcgtgagattgcacccagcaggaacagcttcaatgcttcataggtgtaatcgtctgcgtcagcccccagaaagtgccgcaggcagaaacggattcgctctgtcccgtcccacacaagggtattgagatagtcccggatgggatggtacttgttttcatttgccacaatcccgatggcgttatcaatctttttctcattggtaagcccgtaggtttcttccagatagagaagcagatatttcatgtccgtatcgtttaaggcggtgctgtccctgtggaagccgatgggctttatgatgtccttgcggtcggtcaggatgttgtatgcgatagccccggaaagcagcgggtcacgctggaatacggtcaggcagttccgtatgctctgacggacaccgcctttctcggtggtttccagccccgccttgatttcctcaatgctctggggcggctgcatggcgttcatggtgttttttagttcttgctgcgtctgcggctgcaagctctgccattcgctgttcaagctgtatcacatcctttccgtattccgtaatcaaagccgctttttcctctgtttccccgaacagcagcacatccagcagatattccacatggtcttgcttctgtaaggcttccacaaaccggggatgaaagacttcctccggggagtgcggggcatattcctttctccacactcggagtaggtggagataatcggcaagaatacggaagcagcggttttttgcttcctgaaactgttcctccggggatttctgccggggcttgggcttttttgcttttcccggcggtttccagtcctcataggaaagcccgaagtcctgtgccagttgtacggcggcgtctttctttcccagcccatacagggcggcggcaaaatcaatcacatccccatccgcaccgcagccgaagcagtggtaacgccgatccagcttcatgcttggggttttatcatgatggaacgggcagcaagccatcccgttccgccctacatggattccataatgctccgcagcctgtctggttgtgacggactgcttcacagcttcaaatacattcaaatctatccctccttgaaaaaagaaaaaaacacctgacattctctgattgaaaatggcaagtgcctgttaaagttccatatcctgttgtctgtgtttcgcctgtgccggggcggttctttgtgcttttttctcgtcagtcttatcctgcaagatttctttgataggctgtttcttgggcggctctttactttcctctgtgccgggtgtggctttccgtacccagtagcggatgtcccgcagcttcttcaaatcctcctgtacctcggtcagcggtactttcagctctgcgatttcgctaagaagcatttcctgctcctcttgcagctccttttgggtactgtccttatcgtccgggtgcttggcaagataggcggcggctttcgcataccgggcaacctctgggtgttcctgtttgaatttctcctttgttttcttaaaaaatatcttctggtacttctcatagacaggcttacattccttgcagtctgtccggctggcaagaatcccgtcaatcactttgctgcgggcttcctttggcttcatctgattgcggtaatctgcggctgatttcccggaagattccagaaatgcttctaagtcctccacagtggaaagccccttttgccggagataggatagggcttcgctgactgcctttaagtcctgtgaagtcccccggttctgtccagcccttgtccagtccttccgttcttcctttcgtatctccatatacttcatcagcagattgggaagaagtgttgcttcctccgccgccttttgtgcaagcagctctttccgtttttcgcccagctcggtaatccagcctttgaggttttggataagctgccggatggacttcatcagattgttggcagctctgatttcccggttcaggttgccgatattcgtctggatacctcgcttttccatctgccggacagcagctccctcatggacagtagggactatatcaagcccctgtctggcataggaacgcaagtccacacgctccgggcggtcattggcttccagatagcggttctggatgacctcccattcatgccgccagatttcacaatacttctggttgttccagtccaccgtatcttccttgtggcttttcaacctgccggatggcagttttatccgttccccgttctcatcaaggtcataaaccttgcggcttttgggaagccatttcccatgttcgtccattgcccgcatggtcagcaggacatgggcgtggggattatgtcccggcggatgggggtcatggatagcaaaatcagcaatcatgcctttggaaacaaactgcttctggcaaaactcccggacaaggacagcgtactggtcgggcggtatttctctggggatggtaagcacccaccgccttgcaagctgagagttccattgcttctccaccgcttcggcggcgttccataaggtattgcggtctgcatattcctgtggggcatttgccgggagcaggatttcattgtggacgataccacgcttttctgggtagtgcttcacttgctggtcgtattcacagaacagcttttcgccactctggtaagcagcggcggcaaccgcagactgccgctggctgcgctgaacaatcgtgatttcgttgtgcggacagggcatttcgtgtccctcctttcggtaattggtggatgggtgggcgttttaccacctcattttgggcagaaaaaaagcaggagacctttttcagatttcctgctcggtgtgccgctgtgtaaacggcgggtatttagttgtgaaagttcgggacaagttgacccgatgtgtgtagaataacaaactggatttatttttctttacattttatgccgtaatttcccctactaccattttcgtagcccctatatatttcatatctttttccatttatctccacttcgtcatcgttaataaatgtataagacttaccattttcttcacaatactttgaaattgcttccatagtttttgcaagagttgggtaattggcactatcctcataaggaacccaaaaagcttttttaaacatataaaatacctccttctaatttgttaagtaatccacgaattttcaaagcgttataaaataatagtatcatacagcttcgcaaaaatccacttataacttcaaacttgtcggctgggaacagcttgcaacgcaaggtgtccccagatggcaagtccacaaaagggtagctggtggtagccagcgcaggggaagcgtagcgtcccctgtatgatttggagcagaccatgactgcggaaaatcacagccctccggcgaggagccttcggagaacgcaatgcaccaacctctgggtggtgtataattgcgcccttagtaaactaaggggtttccggcttctcccgttccagcagctttttcaatagttcctgcgtgtcctgcctgtgaaaaatgagtttcaacaacagcatgacatcatcatctgtcaggagttccggctcttgcagaaaactttccagcataccgccacgagtgcagagccggtgcgtccgttcctttcgggtaagctgcttcaactggtgctgcaatgccttttcatcattgatggctttccgcagtttcttttcgcttttctccagttcccggttgagtttttccagctttgaggtatcaggcaagggcagcgtcctcctttcccggtatcagcacataaattctattcggttctcccacgccctgacgcacccgcatgataagtccggcggtttccagttcattcagagaacgcttgaccgtcatgggactgcgggacaggactgcggcaatggctgtgacagggaagcagacaaacaggattccgttctcgtcctcctgccctttggatagtatagcgtccagcatccggcagtacatgacctttgcggtgctgctgactggaaatcctgtcaacgctctgggaaagggcatacagggcggcaatggtgtgtctatcgtcataaattcaaaattcattcggtgtgttcctcctttttctttgctcgtttggataaataacgggggcagtcaaccacaaccgcccggaagctctgcttgcacccatgctggcatttccggcataattcgttgtaagtgacacgcccccggtcattaaggtaaaaggaaagctcatgcttcctctttttgctcattctcggcatattgcacttcctcccgttttagtgtatggtttcggggcgattttcggcaaaattacagccatagagccgcctaaaatctcccgaagtatcagcgatagggtagactatccccctatcagattgtcgtgtttcggtatcatttcggtatcagttcgccagttctccccggtgtcgttcctcccctgaatctcacagcggcgtatcgctccctttggtacgctcgtttcggtcagggttcctccatatccctgccaaaagtcatggcgctacatcgccggggaagcatatcccacacaggctggtcattcgattggaataatccatcgatgaactacctgtatcatagaacatttttgtgccctgtgccgtatgtccacaaagtaggaattaagggtaaaaatcagaaatttccacgattgcggaaagtatgatataatccagttaagcggcagtaatgaaaccgccggaaaggagcgtgcgcccatgaaaggagcgacaagcatacaggaacgcctttgggaactccgcaaggacaaaggcttaaatctggaagaattatcagagctgacgggcatttccaaatcagctcttggcagttatgaaaaagaggattataaggaaatcaatcatggcaaccttatcacgctggcagacttctatggggtttccgttgattatctgctgtgccggacagagaaccgggagcagatcaacacgccactaacagagctgcatttgaatgatgagatggtggcacttctgaaaggcggtcggattaacaaccgtctgctctgtgagcttgccactcataaggactttatcaagtttcttgcggacattgagatttatgtagatgggattgccaccatgcagattcaaaacctcaacgcccttgtcgatactgtccggcatgaaatcattgaacggtatcgccccggcgaagacgacccgcatttgaaagtgctgcaagccgcccatatcagcgatgatgaatatttcagccacatggttcttgatgacctcaatctcattatccgggatattcgggaagcccacaaaaaggacagcgagagtgcgccccagaccaccgttgccgatgaattgaaagaaaatttggaagcggttgaaaatttcaagggcagtcgggatgaaaagctggttgtcctttactgcaagcagctcggcatcaactataaaaatctgtcagacgaagaatttcgctggctcattcggattctacaaaaatcaaagaaaacaggaactcctatcagtcaaaggaaaaaacggtaaagaaaaaccgctgttgcatggttgtgtttgcttccatgtagcagcggttggtgctatacttattcagttaaaatttcaaagcgataaagtggaatttatcttagaaattacagcaatgttattttgataaactttcaagaattgaaatatcatgcttatctttatctcttaattcataacctgagtggaaaactctttggccttttaaggatatacaaggaattgtttttccttcaaaaaaagcactaccaaagtaatctttttcaaactcataccagccaccctctaaatcagcttgttttgaagttccgtcctcatttaaaacgaacgggtgaatgtctaagtaaccaagttcatcactatataactctattctaaccggtttccagtctgtatcaattttatagcccagattcaaaagcacatttaacaatttttccgtatgttgagcatcaaaatttatatctatatctctatgaattcttgtttgtttaccagctaaaatatctacaccccatccgccatccaaccagtatgtaattccagtattttcgaataattctattactttcattaaatcttcttttgttgttatttcttttctacccatacaaagtctcctttacaacttctaatttgtaataatcattctaccataccgttatgaataaatcatctcatgtaaaacaatttcttctgcccggttgtgaatgttattgcaacgctgcacccattccatttgacgggtacgcttcaattcctcggtcacgccctcggcagctttcatctgctccatgatggtgtctaaccgtttctgtgcctgttcgttcaggtctgcaagatatgtccacaattccccggtcagggtcaatgtgtgtaatctggctgggcagacttctcttaaatattcccggtgcatccgtccgtactttccgatggggcggtgttcctccggcaacttcaagtccgggatgtagtaatctccaacaaggatataatcaattccgttttcttttattcttggtttcaattcgctcatgttccttacctcctgtggaagcaggctcgtctggtactaactcaatcacatcagagagatattttagaaaggatagttctttttgcaaatcattaacaaaattaggataattgattttgcacaaggacaggagtttctcgtatgagttataaaagattgattccctgcatttttatccttggagggaaggcggtaaaatggtttgatgacccgacagttgtatctgaagatgtaatcgcgctggcaaaagagtacagcgataacggggcggatgaacttctggtatttgacctgtcaagtacggaccaggatcatgatgagtccattgaactgatgaaaaagatcaaccgcgtgattcggatcccgatggttgccggaggaaatgtaaagcggcaggaggatgtaaagaaaatcctctacaccggtgcaaagcgtgccatgctgaatttttcaaagccggattcacagaaactgatcgaagaggtggcaaagcggtttggaaaagagaagatcgcggtgtcactgaatgactttgatgcattatttaagcagcagcatctgatccagacttacagtagccagattgtatttatgcaccgtctggatctgaattccgttgtaaatattacagatattccgtgtgtggttgtgaccgatacactggaaaaggaagagctttttaagatcctggaatgcccgggtgtgaaaggactttctggaatgtatgtgagtcagagaaaaatcaattgtgctgatttcaaagaagagtgcagccagaaaggaattcgtatgacatcctttgagagtctgatggatttttccgaatttaaattaaattccgatggattacttccggttgtcacacagcattataagacgtccgaagtgctgatggtggcatacatgaatcaggaggcatttgaaaaaacagtgaaaaccggacggatgacctatttcagccggagcagacagagtctctggacaaaaggcgagacatccggacattttcagtatgtcaaatccctgaccatcgactgtgacaaagataccctgcttgcaaaagtcgatcaggtaggagcagcatgtcataccggcaatccgacctgcttcttccagccaatcgtaggggatcagtatgaagaaatcaatacgcagcaggtattcgagagcgtgtatcatacgatcatggatcgcaaagagcatccaaaggaaggatcttacacgaactatctgtttgaaaaaggtattgataaaattctgaagaaggttggagaagaggctgccgagatcatcattgcggcgaagaatccgaaccaggaagaagtcaaatatgaaatgtgtgatttcctgtatcatatgatggtgctgatggcagaacgggggatcacctgggatgacatcatggaagagatggcaaaacggtaaaaattgcatatgtgaaaagatgtgggacatatactgaggtagaggtatatgtcctttttgtttgtctgaaattgggaaagaactttctggtaaatgaaaagaactacctgccaaagatgcgcactcgcgcaaagaagaatgttgcaagtaactgcgttcggtgtagaatgcaccgaggcacattcattttaattggatgctttagcagaagggagagattggaatgaacgaatcacaggaacgccgcgaggagttgcttaggatgtcacgtcaaaaatggagaaagggcagtatcccggcggtgcatccaaggtatcagcatgtatacaggggattatatggagaacattcttcagaagaaaatggcggaagcagtttctttgcgcggatgtttatcagtttccttatctttgggatgtttgtggcggcagattatacaggagagaaaatctggaaatatacgccctcgcagatcgtgtcacagattgagtatcagccggatattatgggtggaaaatggtaagagaagataggaaagcagttctatggcggagacggacttgtagaaaatacaatccgcaatatcggagagcttgcaaagaagggaatgcgtgaaacggataagacaatcatccagatcataacaaggtaacatattgacaaagtaatatgaacaggaaccataaatgtagaaattgtgtatttttaccaaaaaaacaccacatatggttaaatttgtgctataattaaaaataatcaaacaaaagatgaatggaactcctaaatttaatgtttcatacattttattaatgcaattgttaatgcgaagaagaattttttgaaaacttcaaaaattaacatacaacttatagtctatttacgagaggaggatcaattattgaagtttaggaacaaatttatagcaaaaaggatcgggacaaagacactggcaagtcttctggcatttggaatggctcttggttcgccaatggcggcatttgccgatgatggggaaacggccgttgtagcagagaatacagtgcaggcaaaaaagacagatggatcggaagcatttgtgagtgtatctgattatgtacggggaatgatggaaagcggagcagtcaggctgaataatgaaaccggctatctggaagatacctcgactggtcagaaagtggatccggagacaggagaacgcctgacagagacaccggatgttccggagacaccagccataccggacaatcctggaaatgaagaaactccagagacaccggaaaaaccaggtactccggaaaccccggaaaatccagaaattccagaggctccagaaaaaccagaaactccagaaaaaccggacactccggaaaatccagggacaccggaaaaaccagaaactccagaaaagccggatactccgggaactccagagacaccggaaaaaccaggcactccggaaaatccggatagcccggattccggcaaatccgattccaaagatccgattcagacaccggatactgataaggcagattcttccgaagaccggaaagatacaaagatcgatccaattccgggaagtgagatcgaccatacacaggagatcagcaaagcagaagaagcagacagtcagaacgaatcaaaaactgcagtcagtaattctgaactgatcagccgtcagcagattgtgaagcagccagagatggtagaggatttccgtttctggactgtggcaagaaaataggcatttgccagaacagcgatcaatgtacgggaggaaattccggaagctgcagatggcagggcagatacttccgaggaagccaaagaagcagagcttgaagcggcaaaaaaagatgcaaaagagctgagagccggatttgatatagagaatcaaaaatacaacacgaaaaaagtgaaacgtacaaaaacggcaaaaggtgtaaaaaaatctgcacagatcaaactaaccggactcaacattttttcatcagcgaaattaaagacagaggcgccgaatcagaccaatctgaaagctggaaaaagagctgaaacagcaagacaggctgagaaggatctgcagaagcagaaagaagaacaggcagcaaaagtgactgctgacctggcagcacagcagatggaagaaaaggtccgctcggtcggaacgatttcgcaggacgggcttctttatattttgaaagaagaagacaatggctggttgtatgtggaatccggtaatgtcaggggatttgtaaaggcgtctgaaatttatacggaagatgcggcacaggaacttctggatgtctatcagacacaggccaggttaaaagcttccaaagaaaacaaagactataccggaatcgagggaaccgcaaagacggcacaggcactggtagaggctaaagataatcaggcatatacctatctccgtgcgacggtgaaccagacggttgcagataaagaaccggcactagtaagcgaacaggtagatactgataaaaaaggaatcctggatattcaggaggagaagaatgcggattccagagttgtcggaacaatgacagcaggagagctctgctacattcttgcagatgaagattcagactgggtttatgtagaatccggagatgtcagaggctttgcggaaaagaagtatttgaaatcagatgctgaaaccaaagcacaggtgacagaaagaggagctgattcctattcggtagcagataaaaacatggatccggaagataataaggctctttattatacgctgacttctacaaaagaaggaacgccgagtggtgagatccgccagtcaatgattgaatatgcatcccagtttgtcggtaatccttatgtgtggggcggaaccagtctgacaaacggagcagactgttccggatttgtacagcagatttacaaggcttacggatatgatcttccgcgtgttgccgaggatcagagccagtatggaaccaagattccagtagaagacgcacagcctggagacctgatcttctatgcaaagaacggttatgtatatcatgttgtgatgtatgccggagatggaaagacgatcgaagcagcaaatgaagatgtgggaatcatttacggaactgtttataacaaagatgcagtatgggcaacccggatcctggacgatcattatactgttgcaggtggtggaatcggaacagtcaatgcgacagaagagatgtacggcgcagatcttggcaattttacgattacatattactgtgcatgtgaaatctgctgtaacaaagcagacgggatcacagcaaccggaaccccggtcattgaaggacagaccattgcggtggatccgagtgtaatcccttacggaacaaaagtcatcatcggcggacatgtatttactgctgaagactgtggtggtgcgatcaagaaaaaccacattgatgtctatgtaaacagccatgaagaagcacttgctctcggcgtgacgaatgcagaagtatatctggttaaataaaaattaagcgaaggataatttgttctttcggagtttatctaaagccataaaaacagggaaatgttctgacgtaaaatatgtcaggacatttcctttttctcattttaccaaaatattttccgaaagaaattactctctgagtttgaaaaattttatcagaaatatttttaatgaaatatggacggttttgtcaaagagtagtaaaataaaaatgtcgcgtttcgactaaaaggactgcattttacagaatttgtaagaaggagcaacagattttgaaatatagaaatatacaggtagcaaaaatgacaggagtaaaaattctagcaggattacttgttttcggacttactttcagcgctccggcaacagcttgggcagcagagagcggtcttacagaggttacttctaatggatcagaaaatggagaaaaattacaggcaaaatccattgatgggcgtgatacacttacagaagtatcagatcttgtcctggagatgattcataatgaagaaatcagatacaatgaagagactggatatctggaagataccggtctgcgtgatgcagcgaaaacaggatggaaggttgatccgataacaggagatgaagtagaagtaatcccggctaatccagatgtgccggttacgccggagcaaccgacagatccgatcaatccggatacaccacagcagccttcagatggcaatgtgaacaatgaacagcagccttcggaagatcagacagaaggctcagaagaaaaaaacaaagcgcaggagcaggaaaaaaatacgcaggatagtgaacacaagatgaccaatgaagaactggtcaagagacagcagatcgtcagtcttccggaatacgaagaagatttccgtttctggacagttgcgagaaaatatgcatttgcaaagacaaagatcagcatacgtgaggcaattccggaggatatcagtggagccgttgatactgatcggacagaaagtgatattcaggaagcaacagctgatgctaaaaaactgtttcataaggaaacttctgtaaaggcgaagaaatcaaagacgaaatcttctgcgaaaaagacgaaaacagcaaagaaagtacagcttaatacattttctgccgagacattaaaaaacacagcagacacttcgggaaagaagtcatccttaaactcggatactgctacagcattgcaggatgatactttaaatgcatccccagcatcccggcagttgaccgaaaaggtgcgttctgtcggagaaatttcacaggatggacttctctacattctgaaagaagaaaagaatggatggctgtatgtagaatccggaaaggtcagaggatttgtaaaagaatccgagctttataccggagatgccgcacaggtactgctgagtggataccagaagcaggcaaaaaaagctgcaaaaaaagccaagattgcatacactggaatcgaaggaacagcatcccttgcaaaagaaacggttccggcaaatgaaaatcaggcatttacccatgtacgtgcaaccgtaaatcagacactggctacgaaaaaatatgcactggcagatgcatcaaagtcggatggaactgtagcaatccaggaagaggcaaatggacagtcacgtgtgatcggaaccatgtcccagggtaatctgtgttatatccttgcggatgcagagaaagactggatctatgtggagtccggggatgtccgagggtttgtctctaaagaggctgttcagactggggatgaagtaaaagcgcaggtagaagcagcaggcgaaggtgcttaccagacagctacagaactgatcgcaccggaagataaccgggcactttattatagctatgcttctgtaaagccgggaacaccggggaatgcgatccgccaggcaatgctggattttgccgcacagttcattggcaatccttatgtatggggcggtacaagcctgacagaaggggcggactgctccggatttgtacagcagatttataagacttttggctataatctgccaagagtagccgaagatcagagccagtatggaaccaagattccggttgaagacgcacagccgggggatttgattttctatgcaaaagatggttatgtccatcatgttgtgatgtatgcaggagacggaaagaccatcgaagctgcaaatgaagaccagggaatcatttccggaacggtatatattccggaagctgtctgggcaaccagaatcctggaagaaaattataatctggaaggcacggatgtgaacgaacagaacgctacagccgaacagtatggagacagtattggagagtataccattgattattattgttcctgcgagacttgccgtgcgaaggcaagcaaagtcaaagcaaccggaactccggttgttgaagggcagaccattgcggttgacccggatgagattccatatggaacaaaggtgatcattgacggacatgtatttactgctgaagattacgatacttccggcaaagaaaaacatatcagtatctatgtcaatgagcatgagactgcacagaagctgaatgagaagaaggcagaagtacatctggtgaaataaagacaatcaaaaaaagaaatattaaacaagaaaaacttcggatcactggcgaaaatccagaatatccgaagttttttgcatgtctacactattcagacaagtcattctcccggctaatgtttgatctttttcagtttttcattgtctgcctgacattcggtcggggaaatatgatacattttcttaaaagcacgaaaaaatgaagaatagtctccaaaaccggactggacagcaaccgttttaagcggaacatcctgccggatcagcgagaccgcaagtgccagccgtttctttaaaatatactgatgacaggtcgtattcagttgtttctgaaaaaatttgttcagactgctcttgctcatgtggaaagtacgcgccagatcctccacaccgatttctttcagaaaatgctgatccagatagcggacgatctgattggtctgatcggattcgatctcaataaattcgttggaatatttcagggcatagttaatgacttttaccagaagacaggtggatgcaccacaggcataggtttcagaaagctccccataagaagcatattcccggtaaaaggtttcaaattcttcctcaaaattacatagcttattggtagtatgaagaagatgaggtgtgtcaatattgaaaacagattccttaagggccggaagctggcttttcagattggaaatatatgatttttccagccatacagtgataaaatcataatagtttgcaacgagatcactggaagtaaagtagtgtggaatatccggtggaataaccagaatatcaccatttgtaataaaatgccgtttctggccgatgcggaacagaaaatctccgcttttacaaaagctgatctcataaaatccgcttttgatcatggaaagatcttccatcagatatcctttgtggtgcgtgcattttacatggcgcagctggcatttgccggacagctgcatttcagggctttgctcatataattttttcatttataaacctttcatgttgaataaaatttaacaaatcttttgtaatcattatacaatacacattgcaaaaaaggtaaaagaaattgtaaaaaaattatattttttactatagataaaagcaataaattgttaaaagatacaaaaataacgggaaatcagcgttttctggaattattgataaacgatagcaataagtgcaaaaattgatagaaaaaagcaatttgcaaagaaaaaaacattttggtagtatttttgaagagttgttaacgaggggatacacagacagaacaacttaaggaaaataccatggaggaaaaaggaaaatgaaaagaagagcactcgcattattgtgtgcaggaattttagcagtcggtatgcttgccggatgtggtggaagttccgacaagaaagacagcagcgcaaagacagaagacacgaagaaagaggcaaaaagtgatgggacttttacatttgcattgaattatatgccaaattcacttcagccaagtgcacagagcagtgatgacttggtaagtgcaatccgtccaatctatgaaccgttatttgctgagacaaaagacggtctggaatattatctggctgataagcttgatatttcagaagatggtcttacctacacacttcatattaatgacaaagcaacatggagtgatggagaaccggttacagtaaaagatatcaaatttaccattgattatggtgtattggtttatggcggacctacatcattcaccaaggtaaatggtggagaagtgcagatcaacgagattgatgataagacaatggaatttgtacttccatcagtatatgataactatgtcagaacgttatctcagttctatccaatgccggcacatgcatttgataatgatccgtcaaagattaatgacagtacatacttcaaaacaccgggtatggctacatctggagcatatgtagtaagcgaaattaacgaagatagttttgtttatacagcaagagatgactactacagaggaactccttctgttaagaaagtcgttataaaaacaatcggcagcggaagcacaaaacagatcgaatttgaaaatggcggaattgattatatgcgtgttacaagcgcagaagacctgaagaaatacaaagaggagtctgataaatacaatatgtacagtatatcagaagctcgtcttaattaccttcagttaaacccacacggaccggtaatgtctacattatctcaggatgcaagaaaagcaatcttccttgcacttgacaaagatgcgattgttgattttgcatggggatcaaatgaacttgcagagccagcgaacagcctcatcacaccggaccagtctatttataataaagactgtaaaggatataacttcaatctggaagaagcaaaaaaacttgcaaaatcatctggattggaaggaaaagaacttacatatatttacaattcagaccgtgcaaatatggaagctgtagcaactgtcgtacagcagcagttagctgaaatcggcgtaacagtaaatattgaaagctgcgatacttctacattcttcccacgtttctttgcaagcaaagataaagaactggctacaacatgggatcttggtacaaacggatgggattcacagcgtggttcaaactgtggacaggcaatcagctactttacaaatcgtctctgtgattgtggatacagtgatgaagtttcagggcttgctcagaaagccataggaactgcagatgcgaaagaaaaacaggaactttggaatacaattcaggacaaagctttggaagaatgttgggaatacccacttacatatacaaactttgttatggtttcgcagaaaaatgttactggtttagatggttcgtcagttgttcctgaattcattgattacttatctattcatgtggattaaaaatttacactagctgaaaagcatacggaatgtggcatgcctttaaagtaaagacaagccacattctttcatatattcgattttacagagaggaatacttatgtggaaatattgtttaaaaaagacggctcaggtagtaatcgtaatgatattgatttcctttttttcatttgcaattgtctattttgcaccaggtgacatatcggatatgtatgtgaatccggaaatgacggaagaacagaaagctaatgtgattgcacaattggggttggataagagcatgacagagcagtattttgcctgggctaaacgtgcggtacacggagatttaggtgtatccttatctaataagtcggctgtgtggccacagtttatgcagcgtcttccggcaacaatcatacttatgggaagttctatgatcttgtcacttttacttgcaatcccgcttggcttatggtcgggatataagaagaactcatggcttgataacttgataagttcgttagcgtatatgggaatgtccattccttctttttggtttggtatgctgcttattattgtatttgctgcagtattaaaggtattaccttcttccggtatgcataccgttggaaatgtatctgcatttgatacgttccagcatatgattcttccatgtattacgcttagtatcggtcatgttgcggtttatatccgttatatccgtgcaaataccatcggacagttaagcgaagagtatgtgcttaccgccgaagcaaagggagattctcagacgaaaattttattccgacatgtgttgaaaaacacgctgttgcctatcattacattgatgggaatgaatctggcatctttggtatgtggatcctttattgtagaaagtgtctttggatggccgggaattggaacctttgcgatgtctgcgattggttcaagggattatccagtaatcatggcgtatgttatgctttctggttttcttttggtagtcggtaattttattgcagatttattgtatgcctttgttgatccaagaattaaacggggaggtgcatccggtggaaaataatatagtaataaccaacgattcgtttgcaaaactggaaaaaaagaaaacagtagaaatttctgtggagagacagagtgtatggaaagatatctggaaagaactaaagaaaaacaaagttgctatggtaagtgtcgtacttcttgccattctcatcattgctgttcttttggcacctcttagtccttacgatccttataagttagacgcctctcaaaagctgcagggtatttcatccagtcactggtttggcacagatgagtacggaagagattattttaccagaaccttatatggtggaagagtttctttgctggtgggattcatgtctatgatcatgacagttgtaatcggaacatcattaggtgtattctccggttatgtcggaggaaaagtagatatgtttttgatgagttttacagatattttccttgctcttccgagtatgctgttaatggttattttaaatacctttttaaagcctggtttaccgactctgattgttgtgttgagtctgttttcctgggcatccgtcgcaagaattacgagagcggagacaatgtcattaaaggaacgagattttgtggtggctacacagaatctgggggcatcaaactttcgtgtgatcattaaacatattatccctaatattttaggaccggttattgttgcagcaagcttgagtgtggcaaatgcaattctgatggaatcttctctaagtttcctgggattaggtgtgcagattccacgtgcatcctggggaagtatgcttcagggagcacaggcgcatattttggattaccctttattggcggtatatccgggcgtaatgatcctaattacagttttgagctttaatttactgggagatattctgagaaacgcattagaacctaaaattgtagaataacaaaatatgcagtgaccaccttagtgaaagggatagaaaaaatgaataatttattagaaatgaaacatgtggctgtgaattttgctgcatatggaggcactgtgcaggcggtgcgggatatatcgttttctattgaagaaggacagacggttgcactggtaggtgaatcgggctgtggaaaatcgattacagcgaaaactattatggggcttgtaaaaaagccggggaaagtaatggaaggaagccagatcatatttgaaggtacagatatcgcaaaatattcttctaaggagtggaaaaaattccgtggcaaagaatgttctatgatttttcaggatgcacttgtttctttaaatccgaccatgaaaatcggaaagcagatcatggaaagtcttgacaatcatgccgtaacgacttctaaagaagaaaaaaagaaaaaagtaatcgatatgctgaagttaacaggcattgcagatgctgaaaaatgtcttgaaaagtatccgcatgagttatctggtggaatgcggcagaggattatgatcgcaattgcattgatttctcatccgaaattgttgattgctgatgaaccaaccacatctttggatgtaacgatccaggcgcagattctggctgaaatgaaagctctgcagaaaaaactgaagatggcaattctgctgattacgcatgatttaggaattgtggcggatgtggctgataaaattatagttatgtacgccgggaaaattgtagaagagggtacggtcagagagattttctatcatccggttcatccatatacaaaagcccttttaaattccgttccacgactggacagagacggaaaagaaatgctttgtaccatagaaggaaatattccggatatgacaaatccgccgaagggatgtgcattttgtgaaagatgtccgcatgccatgaatatttgtgcacagtatatgccggaggaaaaaacggtatcttccagtcacagggcatcctgctggatgatggatgaacgtgccgcaaagggaggtgttgcacatgcctagccaaaagaaaatcttagaagttaaaaatttgaaaaaatattttccgactactcaaaaacaacagttaaaggctgttgataatgtgtcatttgatatttacgaaggtgagactctgggaattgttggtgaatccggatgtgggaaaacaacctgcggaaaaacctgtcttggaatgtatccggtaacagatggagaggttctgtttcacgggaagaacattcataccatgtcaaagaaagaacggtttgcatttacaaaacgtgtgcaaatgattttccaagatccgtatgcttctcttgacccacaccagaaggtttatgatataatagcagaaggaatccagattcacgggatggcgaagaacaaaacggaagaaaagaagatggtagcggaactacttgagatggttggattgaatgcagagcatgcagcgagaaatgtccacgagttttcaggtgggcagcgtcagaggattggaattgccagagcactttccgttaatccggaattcttgttttgtgatgagcctatttcagcattggatgtttcgatacaggcacagattataaatctgcttatgaaattacagaaagaaaaaaatctgaccatgttgtttattgcacatgacctgtctattgtaaaacatatatcagatcgtataggggtaatgtacttggggaaaatggtagaacttacagaatcctctaagttatatgttgaaccaaaacatccctatacgagagctcttttatcagcggttccgattgcggatcctgaggcatcagcagaaaaagagcgtattatgttaaaaggcgatgtcccaagtccggtgaatccaccagttggatgcagatttgcaggacgctgtgaaaactgtatggagatctgtcgtaaggaagaacctcagatgatagagattgttccgggacattatgtggcatgtcacctgtatgatgagataccagggtcaaaaggtcagaaagccgatgcaagcttgcttgcaagagtgcaaagcacgtagcaatctggtatcaaagaggtcaaaataccttttgactacaatatcatgatgactaaaagaaaaaaatgtatgtaacagagtccagctaataaatgtcaataattaaatgagaaaaaaatattttgttttctgactaaaaaagggcagactttcctcccttcttctgttatctgatttatagaaacttattaacctagtagtcttgattgactacatcattattatactaggagaaagaaaaatgaagtacgattttacaagtattattgaccgtaaaggaaaagatgcccttgcagtggatatccttccaaatatgcttgggccggggaaaaaagtagaagtaagagaagggctggattacattccgatgtgggttgcggacatgaattttccggcactcccgaagatcaccgaagcgatcattgaaagagcgaaacatccgacctatggatattttattaccagagatgagtattacaacagcatcatcaagtggcatgaagaacggaatcatgtgaccggactgaaaaaagaacatatcggttatgagaatggagttttaggcggcgtggcaagtgcacttcacgcagtctgctcacagggtgacaatgtccttgtccatgcaccgacttacataggatttaccggcacactgaataataatggctaccatatcatccacagtccgctgaaaaaggacgaagaaggcatctggcggatggactttgaggatatggaagagaagatcgtgaaaaacaagatccatgcagccattttctgttcaccgcacaatccgaccggtcgtgtatgggagcgctgggaaatcgagaaagcaatggaaatctataaaaaatacgatgtaaccgtcatttccgatgaaatctggtccgatattattttatatggaaacgagcatattccaacccagtctgtatctgaagatgcaagaaacagaacgattgctttatacgcaccgtcaaagaccttcaaccttgccggactgatcggaagctatcatattatatacaacaaacgcctaaaagacagagttttaaaagagtcctccctctgccattacaattcgatgaatgtgctgtccatgcatgcactgatgggtgcgtatacaccggaaggacaggaatgggtaggcgagcttcgagaagtgatcggggaaaatgtcgcttatgcatgtgattatatcgacaaacattttgaaggtgtttccgtaaccagaccgcagggaacctatatgctgtttgttaactgtgaagaatggtgcaaggcacatgataagagcctggaagacgttctgaagatgggatatgaagcaggtgtgttctggcagaacggaaagccattccatggtgaatggtatatccgtatgaaccttgcactgccgacatccagagtgaaagaagcatttgaccgtctggataaatatgtattcaatgcttaaaatgcatacaataaaggaggaaaataaaaatggaattagtaaaagagctgccggagatttttgaagaatttgcagagcagagacagagatctttcctggtaatgaaagaagtaaaggacaaaggaattccggttgtaggtgcgtactgtacctacttcccacaggaaatcgcaatggctatgggagcagttaccgtaggactttgctctacatccgatgaaacgatcccgatcgcagaaaaggatctgccgaagaatctgtgcccgatggtaaaggcaagttacggttttgctgtatctgacaaatgtccattcttctatttctcagacgtggtagttggagagacaacctgtgatggaaagaaaaagatgtacgaactgatgaaagaattcaaaaatgtctatatcatggaacttccaaactcacagagagaagattccctggaactgtggacaaaagagatcatccgtttcaaagaatatctggaaaagacatttaatgtagagatcacagaagaaaaagtgcgccatgctgttcatgtatccaaccagggacgtattgcactgaagaaattctacgaagttatgaaaaatgatccggctccgatgaacggttcccagctgttcggtgttctctatggaagccagttcaaattcgacaaagaaaagatgccggcagaaattgatgctcttcgtgaaaagctgatgaaagaatacgaagaaggggaaaaaccagagagaaagaaacgtatccttttaaccggatgtccaagcagcggtgcaccgatgaaggttgtaaaagccatcgaagaacacggtggaaatgttgtagtctatgaaaactgtggaggtgcaaaatctgttgaccgtctcatcgatgaagatgcagaggacatctacaaagcaattgcagagagatatcttgcaatcggatgttccgttatgacaccagataacaaccgtattgaactgatgggaagactccttgaagagtataatatcgagggtgtagtagaaatgacacttcaggcatgtcatacttacaatattgaggcaaagagcattgagaaatttgtaaaatctaaaggacttccgtatatccatgtagagaccgattattctcaggcagatatcggacagctggatacacgaattgctgcatttttagagatgatctaggattcagaatgtatcaaatttaaaagaatgtgtcccggtattctgaaaaagtggatgggattctaacagatttatgttataataggaattaacaggcagggaacaggcatcagtctgttccctgtgtatatttacaggtatatggagaatataccggaattttttcagagagcagctaagactgaggcgaagcctttgaaaaaattttaccagattgaataaaataagagaggtactgaatatgacaatcgaagaacgcgcagcaaaagctgcagatttaaaagctgccggagcatgcaactgttcccaggcagtggtaaaagtatttgaagataagctttcattggacgatgagacactgatgaaattaaccgcaggctatgcagctggaatgggatgtctggaagcaacctgcggggcactcattggagctgtgatgaccgcaggaatcctgacagacggagccggaacgcctcgttattccaaagaaatccttgcaaagtttcagcaaaaatgcggagcaacgatctgcagggagttgaagggcgtcggcacaggaaaggtactctgtgaatgtccggaatgcgtaagaaatgcggtgcttgcactaggagaagtaatggggattgaataaataaaacgatacgaaagcaatttttttgtatgtggttttgcttgtagtggtagcaggcattataatcaaaattgtttatagcagaaagaacacaataaagataaaatgatcctgatttcgaaccggtcatttattacatgaacacagaaacaggacagttggaagaattagaaacgactgttgatatggaaaagagattttatttccccctctcaggtgtaatacatctgggaggggtttttataaccagatatgtatgaatctaagattagtcatgcttttaaacatgtctttgaattatgtggaattgattcggaaaaatatcattgtcaggactttaatatggctaaaatagttgattttctcacttaaacaagctattattaaaagtaattgtcttaataaaatacctgtttcaaattcatcgtttacagtattatataatatgctaaagtgctaaagtatcgctgtgggcgcattctgtcgtaagcagtcgccatacaattcttacgacagaaaacggtaaaaaattgggaaattttgaggcattttttgcaaaaaaacggtaaaaataaagtggttttaaaattgaaaatattataaattataaaatttgtgcgcctgtaattgcacgagaaccataaacaaataaactaaaaatggaggaaaaatgaggaaattagcattagatgatgatattttactgaatatagagaaacctgcccgctacattggccatgaagtcaattcggtcatgaaggacaaaaaagcggtagatattcggtttgcaatgtgttttccggaggtatatgaggttggtatgtcccatctgggaatccagattctgtacgatatgttcaaccgccgggaggatacctggtgcgagagagtctactctccgtggattgatctggacaagatcatgcgtgaaaaacatatcccgctctttaccctggaatctcaggatccggtaaaggattttgactttcttggcatcacattacagtttgagatgtgttacaccaatgtactgcaggtgctggatttatccggtattccgcttcacagtgaggacagaactttagaagatccatttgtcattggcggtggcccatgtgtttacaatacagagccactggctgaatttttcgatatgttctatatcggagagggcgaagtggtttatgatgagcttctggaagcatacaaaaagtggaagagagccggaaaaagccggaaagaatttctggaaatggcagcagagatcgagggaatttacgttccttctttttatgatgtcacttacaaagaagacggcacgatcgaatctttcctgccaaacaatccgcatgcaaaggaaaaaatcaaacgagtagttgcggcagatatgagccagacaacctatccgttaaagccggttgtcccgtttatcaaggttacacaggacagagccgttctggaaatccagcgcggctgtatccgtggatgtcgtttctgtcaggcgggaatggtttaccgtccgacacgtccgcgtgatatcaacatgctcaaagagacggcacgtgcaatgctgaaaaataccggacatgaagagatcaccttaagttctttaagttccagtgattacaacgaactggaagagatcgtcaccttcctgatcgatgagttccacacacagggcgtcaacatttccctgccgtcccttcgtatcgatgcattttctttggatgttatgagcaaggtgcaggatgtgcgtaagagcagtctgaccttcgccccggaagccggaacacagaggatgcgtaatgtaatcaacaaaggtctgacggaagacgacattttaaatggtgcaggacaggcttttgaaggtggatggacgaaggtcaagctctatttcatgcttggacttccgaccgaaacccaggaagatatggaaggaattgctgttcttgcagataaagtagcacgccgatattatgaaattccgaaggatcagagaaatggaaaatgtcagatcacggcaagtagttccttctttgtaccgaaaccattttcaccgcttcagtgggcgaccatgcagccgatggaagaatatatccgccgtgcaggaattgtacaggaagcattccgcaaccagctgaaccgcaagagtctgcgctacaactggcataccgccgaagtaaccgttctggaaggcgtctttgcccgtggtgaccggaaggtcggaaaggttctggaagaggcttaccgtcttggctgtatttacgatgcgtgggatgagtattttgattatgataaatggctgcaggcctttgaaaatacaggtgtagacatggatttctataatctcagaaagcgtgaattagatgaaatcttcccatgggatttcatcaattgtggcgtgacaaaatctttccttataagagaatggaagaatgcaatggaagggaatgtaaccccgaactgccgtgcaaaatgttccggctgtggggcagcaagttacggaggaggtgtctgctttgaaggcaagaattaaatttcggaaaaatggagtgatgaagttcatcggacacctggatatcatgcggtatttccagaaagcgattcgccgtgccgagatcccgatcgcatttaccagtggttacagcccgcatatgatcatgtctttcgctaatccacttggggtaggacttaccagtgacggggaatattttgatatcgaattgaccgagtcaatcgccagcaaagaagcggtcagacggctgaatgaacagatggtagacggcatggagatcgtcagctttgtgcagatcccggatgataagaaaagtaaaggaatgtcaatcgtagcaggtgccgactatttatcttcggtaaaaaatggcagcctgccggaagatcttgctgaaaagctggaagctttttatgcgcagaatgaaatctgtgtggtcaaaaagacgaaaaagagtgaaaaagaagtggacattcgtccgatgatctacaagctggaatgccgggacggaaagatttatatgcgtgtggcagcaggaagtgtccagaacttaaagccggagcttgtcacagaagcgtttgtccgctatcttggtatagatgcggaggaagtgacctttacccaccacagactggaaacttttgcggaatccgaaggcacggagggcaagatgattctggttccactggatgcgcttggaacggagattgtatagatgaaacgaaaagtactccttacggaatgcatgaaccacctggtgcttgcacttttagaggatgagaaagtaacggaatttcactttggcagtagcggagaaaaaaagagctgccgcctgggtgaaatttatgtcggaagagtacggaaaatccttccgaatatcggtggcgcatttgttgaaattgccaatggtgagcaatgctattttgcgctggatggaaaatataccccggttttcaccaataagattggaaagaagccacttgtgatcggtgatgaacttctggttcaggtggagaaagaagcagtgaaaaccaaacagcctgtcgtgaccgggaacttaaatttcaccgggcagtatgtagtactgacttccggcaatcgtaccattggtgtgtccggtaaaatccacggtgtcaggaaagaagaactgcaaaagctgggacaggactatatagactgtgatttcggattgattttccggacaaattgtgtggaagcagaagaaacacagatccgtgccgaaattgacaaactggcagagaactatcacagaatcgtagaatatagcaagatgcggacctgcttcagctgtctgcagagtgcaccggacccgtgcgtacaggcactccgggatatttacaaaaaagatttgacggaaattattgtagaggaaacggtagaagatggagctttgtataaagaagttcagacttatctggaaacggaaatgccagatgaacttccgcttctccgtgcgtatacggatccgtcttatccacttgtaaaatgctataacctggaaggggcgatccgagaagccagacaagaacgggtatggatgaaatctggggcttatctggtgatccagccaaccgaggcgctgactgtaatcgatgtcaattccggaaaatgtctgaaaaagaattctcattttccgaagatcaaccgggaggcagcaagggaagcagttcgccagatccggctccgcaatatttccggtatcattattattgattttatcaacatgaaatcagcagaagagaagaaagaacttcttgcgtatctgcagctggaattaaagaaggacccaaatccgggaaatgtgattggaatgacgaaactgcagctggtggaaattacacgaaagaaaatccgaaaaacactggaggaaagtttacatgggtaaaaaagaagtcaaaacaaatgcaatgcgaattttagacagaaagaaaatttcttacgaatatcagacctatgaatgcgatgaattcacggacggaattgaaaccgccgacaagctgaatctgcctcacgaacaggtttacaagacgattgtcacaactggaaaaagtggcgaacattatgttttcgttcttccgatcgaagcagaaattgattttaagaaggctgcaaaagcggttggtgaaaaatctattgaaatgcttcatttaaaggagttaacaccgcttaccggctatgtgcgtggtggatgcacttcgatcggaatgaaaaagcattttccgacggttattgatgcaagtgcacagcagtttgagaaagtctatgtaagtgccggaagaatcggtgcacaactgacacttgcaccggaggatttgagaaaagcagcggatgctacatttgcagatgtaattcatgcatagaaagttttcaaaaaaagaaattctattagacaaaatgcaagattttcaacagattccaaaagaaaatcttgcatttttcacgtcagcgtaataaagtaataactacataagtgtagaaacatctgcccggtgtttctacagaaaatgcaggtttgccatgtgcagatcagaatacatgaattgagagatggaggaataccaacagatgattaaggtagtgaaattcggcggaagctctcttgccgatgcagtacagattaaaaaggcaggaaagatcgttctttcagaggaatcaagacgttacgttgtaccgtctgctccgggaaagcgtttttccgacgacaccaaggtaacagatatgctgtatcgttgttacggcgcagctgtaaaagagaagaaatttacagaattactcgctgacattcagaagagatatcaggaaatcattgaagggcttgggatcactctttctcttgacgaagaatttgccaccatccgtgataattttgcaaagaagatcggaagagattatgctgcttcccgtggagaatatttaaacggacgtgtaatcgcagcttatcttggatatgagtttatcgatgcggcagaagtgatcaagttcgatgaaaatgggaacttcctttcagaagaaactaaccaggtacttgcagacagactttcaaaagtagagcgtgccgtgattcctggattctacggagcacgtccggacggaacgatccagacattttcccgcggcggatctgatgtaacaggatcgatcgttgcaagagccacacatgctgatatgtatgagaactggacagacgtatccggattcctcattgcagatccccgtatcattaagaatccaaaaggaatcgaagcaattacttacaaagagttgcgtgaactttcttatatgggtgccagcgtattacatgaagatgcaatcttcccggttcgtaaagaaggaatcccgatcaacatccgtaatacaaacgcaccggaagaaaagggtactctgatcgtagaaggaacctgcagaaagccgaagtatacaattaccggtattgcaggaaagcgtggatttgcttctattacaattgaaaaagcaatgatgaactcagaagtcggatttggccgcaaggttcttggtgtatttgaagatgaaggaatttcttttgaacatatgccgtcaggaattgatactatgactatcttcgttcatcaggatgaatttgaagaacatgagcagaaagtgcttgcgggcatccaccgtgccgtgaatccggatgacatcgaactggaatccgatcttgcactgatcgctgttgttggacgtggaatgcgtcagacacgcggtacagccggaagaattttctctgcactggcacatgcacatgtcaatgtaaaaatgatcgatcagggatccagcgagttaaatattatcatcggtgtgagagagcacgactttgaagcagcaatcaaagcaatttatgatatttttgttaacactcagctgtaaatcttcaattcgatccttaaatatggtatagtacaggtgttggggaaaactcccctgtacagaatattcatacaagagaggatacgaaaatgaatatattatttttcctgaagccaaaagcagaagtggcatttgtatatgactaccacacgctcagacaggcaatggaaatcatggagtaccacaaatactcatccattccgatgatcaaccgggaaggtaaatacgtcggtacaatcaccgaaggagacctgctctggggacttaagaagctgaacatcctgaatctgaaagaagcagaagacattgcaatcacgaagattgcaagaagagcagattaccggccggtaagtgccgattccaatatggaggatctgatggaaaaagcgatggatcagaactttgttccggtcattgatgaccagcagaatttcataggaatcatcacaagaaaagacattatcggatattgttacgaaaaaattaaaaaaatcgcaaattaggggttgactttgtgcggtatgccactgtataatacagaggtatgccgcacaacgaggttataagtcctgatttgatcagacaccgtagttggcgagtaatgataataggaggtgccatatgtacgcaattatagcaacaggtggtaaacagtacaaagtagccgaaggcgatatcattaaagtagaaaagcttggtgtggaagccggacagtcttatacttttgaccaggttctcgcagtaagtggtgacgagcttaaagttggaacaccagtagtagaaggtgcaacagttgaagcatctgtaattggtgacggaaaagctaaaaaagttatcgtttacaagtataagagaaaaacaggttaccacaagaaaaacggacacagacagcagtatacagcagttaagatcgaaaagatcaacgcgtaagaagctggtggttatatgatacgagtaaccatttataaaaatgaaaaacatcaatgtgtaggtttcaaagcacatggtcatgcaggattcagtgaagaaggacaggatattgtctgcgcagctgtttccgtacttacgatcaatactttgaatgccattgagaaatttgcggatgaccgtacaagccttgtatccgatgaatccaaaggactcattgactatcgacttaaaggtaatccgactcgcgaggcaaagcttttgcttgacgcgatggttcttggtctggaagagattgcagaagatgagaactacagagaatatatggatttgacatacgaggaggtgtaacaaccatgatgaaattaaaccttcagtttttcgctcataaaaaaggagttggttctacaaagaacggtcgtgactctgaatctaagagacttggagcaaaaagagcagacggacagtttgtaaaagctggtaacatcctttacagacagcgcggaacaaagattcatccaggaatcaatgtaggtcgcggtggtgacgatacattatttgcactggttgacggtgttgttcgttttgaaagaaaaggaagagataagaaacaggtttctatctatccagtagctgaataagcagatttaacagaggcttcaaacttttttggtttgaagccttgtttttagtcataaataaggaggacatattatgtttgcagacagagcaaaaatatatatccgatccggaaagggcggcgacggtcacgtcagctttcgcagggaattatatgttccgaatggcggtccggacggaggcgacggcggtcgcggcggtgatgtaatctttgaagtggacaaaggtcttaacacactggtagatttccgtcacaaaacgaaatataaagcacaggacggagaggaaggcggcaaaaagcgctgccatggtaaggatgcaaaggatctgatcctgaaagttcctgaagggacagttatccgtgaagcagaaaccaataaagtcattgccgatatgtcgggcgagaaccagcgccagattatattaaaaggtggtaagggcggtcttggaaatatgcattttgcaacctctaccatgcaggttccgaagtatgcacagccgggaaagcctgcacaggaactctgggtgaatctggaacttaaggtgatcgcagacgttgggcttgtcggtttcccgaatgttggtaaatccacattcctttcccgtgtaaccaatgcgcagccaaagattgcaaattatcatttcacaacactcagcccgaaccttggagttgtagatctggaaggtgcaaagggatttgttattgcagatattccgggactgattgaaggagcatcagaaggtgtcggacttggacatgaatttttgcgtcatgttgaacgtaccaagatgatgatccatgttgtggatgcggcaggtatcgaaggacgtgatccggttgaagacatttacaagatcaacgctgaactggaagcctataacaaagaaatttccatgcgtccacaggtcattgcagcgaataaggttgacctgatctattccgaagatgaagatccgatccagagactgagagatgagttcgagccaaaaggaatcaaggtattcccgatttccggtgtgaccggagaagggctttctgatcttctttactatgtaaataatgaacttcagaagttggatgacaagccgatcgtatttgaacaggaatatttcccggaagaagagatcatccacatggatcttccatataccgtggaaaaagaagacgatgtatttgtagtagagggaccgaagatcgaaaagatgcttggttacaccaatctggattccgagaagggatttgctttcttccagaaattcctgaaagaaaccggtatccttgagcagcttgaaaatgcaggtgttcaggaaggcgatactatccgtatgtacggtcttcagtttgaatattaccgttagaaaagaacataatttcagaaaggagaagttttatgacttccaaacagagagcttatttaaagagccttgcgatgacaatggatccgatccttcagatcggtaaatccagcgtaacaccggaacttaccgcagctgttgcagaagcgcttgaagcaagagaactgatcaagcttcacgttcttcagaactgtggagatgatctgcgtggaatggcagagatccttgcagagcgtacacgttcccaggtggtacaggttatcggaagaaaaatcgttctttataaagagggaaaagacgacaagaagaaaatcgttcttccttaatgagtggagtatagattatgagaatcggtattatgggcggaacatttgatcccatccacaacgggcatctgatgcttggtgaatatgcataccagcagttccatctggatgaagtgtggtatatgccaaacggcaatccgccccataaatcaaatccggaaatacgaaaagatttacaggaccgtgccgaaatgacacgccttgcaattgaagaaatcccgtatttccggctttgtacctatgaaatggatcgaaaggaaacttcgtactcctatcagacaatggagtattttaaagagacttatccgcaggatgaattttattttatcatcggtgcggattctcttttcaatctggaaacctggaaatgtccggaaagacttctgaaaacagcggtcatcctggcagcatatcgggatgatgcaggagcgccgaaagaaatgcgccgtcagatcacatatttgaaagaaaagtatgcatgtgatatccggcttctccgtacccctgtgatgccggtttcttccagtgagatccggcagatgatccgaggaggagagacagaagatcttccgattccgaaaaaggttgcagattatatagctttgaacagattatatcaggtgagtgaacatgacggaaacaatacttaagatgcagaaaaaagtaaaacggtacctggataaagatcgttatgatcatacgatcggtgtgatgcatacggcaggctgccttgccatgcgttatggtgccaatctggagcaggctttgacggcaggacttttacatgactgtgcaaaatgtgtgccggcagatgaaaagattaagctctgcgagaaaaatcatatcgaaatttccgatgcagagtacaaaaatccgggacttctgcacgcaaagctgggcgcattttttgcccgggaaaaatatggaatagaaaatgaagagattctacgatcgatcgagtctcatacaaccggtcgtccgaatatgtctctgcttgataagatcatttatatcgcagattatattgagcctggaagagatgttgcaccaaatcttccggaagtacgtgcgcttgcatttgtagatatcgatgcatgtctttaccgtattctggaagatacacttgcatatcttgccgaaaaaggtgcaacgttagatcctgcgacagaagagacatttttatattataagaacctgaaaaacagtgattccgaaaaggaggacaaaaactgatgcagacaatcgagcagtcaagagagatggcaaaacttgcctgcgaagcactcgctgacaaaaaaggcgaagatatccgtgtaattgacattgcaggaatctctgtgcttgcagattattttattattgcaaacggaaccaatgagagccaggtaagagctcttgtcgataatgtcgaagaagaacttgcaaaagcaggatatgaagtcaaacagcgtgaaggctatggactcggaagctgggtgcttcttgactttggcgacattatcgttcatgtatttgacagagaaaaccgtgttttctatgatctggaaagaatctggagagacggaaaacaggttgatccggaagaattataaaagaattcaaaatgaggggctgtgaaaaaagaatagtccaccaaaaaaattaagggcttatatgtaacacagattaccgaggacggcgaccttgccgtattatctggaagtaaccagttttccgtttctgacaaggttatccgtggcggtgtcaaaattcagaaacgagatttagaaacgggcgataccaaaccacaaggaagtgcaaccttgaaagatactgcctttgacatcatttccttaaatgataattctgttttggttgagggcaagctatacaagaaaaatgaagtcgtaaaaacaatccatacggacattgagggtatcgcttctacttccgctgaccttttgccttacggaaatttccgtatcgttgagaaacaagctcccgacggttacttaactgacggtgcaaaaccgattgattttacaatcacagaaaatggaaaaatcgtggacttaaccgacgaagctcattctatctacaatcagattaagcgtggagatattgagggtgtaaaaatcggtgcaggtacacacaagcgtcttgctaatgttccctttaggatcacaagcaagacgacgggtgaaaatcatgtagtggtaactgatgataacgggcaattctccacttctgctgaatgggcttctcataagcacaatacaaacgcaggaaagaccagtgaggacggtgtgtggtttgggacttctgaaccagacgacagcaagggtgcattactttatgatacctacatcattgaagaattacgctctgatagtaacaaaggctttgaacttatcccaccttttgaaatcgtggtatcaagaaataatcttgtgattgatttaggaacgctgactgatgaatacgaaaaagaaatctctatccataccacagcgaccagcaaggacggcgaaaagactatccttgcaggaaaagaggttacaatcgttgatacggtcaaattagacggacttacaaaaggcacaaaatatcagctcaaaggctggcagatgttaaaggaagaaaacgccgagcttatcattgacgggaaacgtgtagaaaacgattatacctttgtcgctgatgaggaagaaatgaaagtggaaatttcctatacgttcaatgcgtctgctttaggtggcaaaaaccttgttacctttgaagaattgtatgatttaagcaatccagacgaacccgtaaaagttgcagaacacaaagacattgaggacgacgggcagaccgtacttatcacagagcgtatcatcaaaattcatacgactgctacggataaggacggcaacaaagagcttgaagctggaaaagacgttacaatcattgatgcagttgtggaacttgtcaatccagtagccgatacggtatcacgaaaaacctatacaggtgcagatgtggactggtatgtaaaggcagaggatattgtgttgaagaataaaggcaatcagaacgcaggtaatccacagaaccctacaccgcagggacaacagaaaaaataggattgccgagtaaaaattatattgtagagcatactgcataacggtataattatttcatatcaaatataatggagtgatgaaaatgaagcatatcttaattgttgatgatgatattcatataaacaaaatgttggacgaagttttagtacatgaaagatatatggtttcccatgcttactctggtacagaagcattattatttttagcagatacaaaaccagatttgattttgctagacttaatgttaccgggattgtctggggaagaattattaccacaaatatcagatattcccattattgttatgagtgcaaaagtagatgttgaagataaggtatctcttttacttggtggtgcagttgattatgttactaagccttttgatacaaaagaattattggcaagaattactgttgcacttagagttaaaacaccctcattaaacagaacattagaatttgaagatattacattggatacatttacttatgaagtgttcatagaggacaaaaaagtaaaactgacgagaacggaatatgctattttgaaattgttaatacaaaatccgaagcaagttattgtaaagtcatttcttttagaaaaaattagtgaggacacaccagactgtactggaagctcattaaaaatgcacattagtaatttaagaaaaaaacttcgtgatataagtggaaaagattatattgaagctgtttggggaattggatttaaaatgagaacagaataaatctttactgtttctttactgttttctttaccgttttctttactcttacaagatagaataactatatcagaaaacaggaggtaaaaatcatggaatatgttcttaaaacaaattctttatgtaagaactacgggcattttaaagcactcaacggcttatcaatgaatgtgcctaaaggttcgatttatggtcttatcggcaaaaacggagcaggcaaaacaactcttatacggttgatatgtggtttacaagagcctacatctggcgactatgttctttatggcaaaaagcacatagataaggacattacaaaatctcgtcgcagaatgggagcaatcgtagaaacaccgtcaatttatgttgatttaacagcgtatgaaaatttaaaggagcaatacaaagtattaggtattccctctgatgatggaatttccgaaatattaaaattagttggtcttgaaaatacgggaaataaaaaagcaaaaaatttttctcttggtatgcgtcaaagactaggtattgcggttgctcttgcaggttcgccagattttctcgttcttgatgagccagtcaatggacttgacccacaaggaattatagaaattagggaattgatcttgaagctcaatcaagaacatggaattaccgttttgatttctagtcatatattagacgagctatcaaaactggcaacatactatggctttattgacaatggtaaaatgataaaacagattagctctattgaattggaaagtaaatgccgaaaatgtactcatttaaaagtatcaagcacaaaaacccttgcttatgttttagacactatgaacattgaatataaaatactttctaatacagaagcggatatttttgaaaaagttaatatttcaaaattaacgacagaattatccaaaaaagattgtgaagttatttcgatacatgaacatgatgaaagtttagaaagttattttgttagcttggtagggggtgcaagacatgaataaattattatctgctaatttctttcgattaaggaaaaataaatgttttaggggttcattagcttttatgtttgtgattggaatagctagcccactattgagatatagggatatgaaacagtctggatgaagattacggacattacagttatacggagcattactctttaggggacatctttatctatacgtcggctgacgaagaaaaaggtgtccttttagagttaaaggggcgtggttgcagacagtttgaaagttacctgctggcacagcaaagaagctggtatgactttctcatggacgcactcgtagacggtggcgtgatgaagcgtatcgaccttgctatcaacgaccatacgggcattttggatattccagagcttgcggaaaaatgcaggaaacgggaatatatcggaaagtccagaagttataagttttaccagtctggcgaacttatcaagcacagagaggacgacagagaatatatgggacgtaccctttatcttggttcgctgaaatcagatgtgtatttctgtatctatgaaaaggactatgagcagtacgtcaagttagggacacctctggaagaagccgacattatcaaccgttttgagatacggcttcggaatgaacgagcctattatgcagtacgagatttgctgacctattatgacgcagagcagaccgccttttctatcatcaaccagtatgtgcggtttgttgatgaagaaccagacaagcgaaaaaatgactggaaactcaatgaccgctgggcttggtttatcggcgataacagacagagcttgaagctgacgacaaagccagagccttacaccttagaccgtacattgcggtgggtacaacggcaggtagcaccgaccttgaaaatgctgaaaaagattgataaaggaaacggtacagactacatggaaacaatcgaacagcaggcaaagctcacagaaaaacatgaaatgataatcaaacagcagacgacccctgcaaaagatttggtggaaagttaggagtgatgaaaaatgtgggaaatattgaaagacttatttctggtatctatgggaatgggtatcggcgtagtcttgatgtgtattttgaatgtcggcaaagaagctgacagacttatggaagaaatcaaagaaagtgaggacaaataacatgaatttcggtcaaaatttgtatcaatggtttttatcaaacgcacagagcttagtgcttatggcgattgtggttatcggtatctacttagggttcaagcgtgagttttccaaacttatcggtttcttggtagttgcccttgttgctgtcggattggtgttcaatgctggcggtgtaaaagacgtactgttagagctgttcaataagattatcggtgcataaaatgttattgtggtgctgatatgagaatggtataatgtggatatgaaaaaacaataaatttgaagctgtggaggtatttcatgaaacgagagttagggattgctagatgtggtcttgcgtgttgtttatgcacagaaaatgttgattgtaatggttgtggttcaaacggttgtccagataatgagttttgtgaaaataaaaaatgttcgattgcaaaaaaaatttctcattgttatcaatgcgaagaaaattgcaagaaaggattattaagcaaaattaaaccatatacatttactctatttgctaaaaaatatggagaagaaaaactattggattgtttagagagaaatgaaaaaaatggagttgtgtatcacagaaacggcataaacggagattatgatgattttgatgatgtagaacagttaatgaattttattctaacaggagtacgataattttctgtttttgagagagcgtggaaacacataagaatttgaatgtgaggtagaattatggcgtcaagtaaagaatatttacaatttgttttagaacaattatcagaattacaagaaataacatatcgtgcaatgatgggagaatttattatctattatcgtggaaaaatcgttggcggaatatatgatgataggttgcttgtaaaaccaacaaagtccgcaatttcttatatgccgacagttacttatgaaattccatacgaaaatgccaaagaaatgttattggtggaagaagttgataataaagattttctgacggggttatttgatgtgatgtatgatgaactacccacgccaaaacctaaaaagaaaaaataaacagcttctagttttacattttcatatccatacacacaaagcagttagtcttaggattgactgcttttttcttacctaaatttcagattggagtgatgaaatgaacgatatttttaaggatatgcaggcaaacgtcggctgtgattatatttccgacctgccctcttacaagcgtaaggtgtggcaggaaatgaaacggctgaaccctgccgactatgaagaaagacagttagaagatttttcaaagtatgtgtttggtatgccgtaccagaccttaaaagatgtgatgaaacaacagaaaggacgtgaagaacaatgcaggaaacaagggtgctggtggaaacgagaggaacaactggcgaagaaacaatatcatactggttcgacttgccgatagatgttgccgagtttgaagaaaagctaggtgtcggtgcagaaagtcaagattaccgtattatcgaaaaggtgttgccttatgctgatgaagttcacgaacatacaagcgtgtatcagctcaacgaattagattttatgtaccgccagttttcaagcgatatgcaggaagaatatgtatcactacttacggtgtttgagaatttagaagcactttatatttgcaggaacgtgattaccgtttatcccgactgcaaaagcatgatagatgttgcaaggcaaaagctgatgaatgacacgacgttcaaacatttgtccgaggactgtcaagcctattattttgactttgaagcctacgcttctcacttgcaggaacacgggaaatttttagtaacagaacacggtatctttgaactgccagagtaggaaatgaggtggtgcttatgattgatgatatggcggtttatattgctaatcttggaaaatacaatgagggctatttagtcggtgcttggttcacgtttcccattgacgaggaagacgtaaaagaaaacctatactgtaaaagtctatgtggacgctgacggggatatggtaatcgttcagaaccctacccttgcaccagcaatcgagaaatcagactatgagccaaagacaccagaagcagacacaagtgtagacgctgatactgtcaatgacgctaccgcatttctggaaacattctttaagctgtacccaacagccacagaaaaagagcttgcctactatgtagctggaaatgtgattgaacctatcggcagggactacctttattctgaattggtaaaccctacctttacaaaggacggggacaatgtgaaagtcaaggttgctgtgaaattccttgataatcagacaaaggcaacgcaggtatcgcagtatgagcttgtgttacaaaaagatagtaactggaagattgtaggataaatgatataaaaagaccgtagcctgtaatacacatttatgtgccttacagctacggttatttttgaaattgattgcgtatatccttgtctttacgaaacgctattttagcggacttcattaaatctactaagaaacgtacttcgtattcatcacagtctgaaaaaatatcttttgcttctttttcaaaaatgattttagaagcaatcacattatcgcataaaagagtatcgactgatacagaaagtgcattggcaatcgcaatcaaggttggtaaactgacttttgtttttcctgtttctacattactcatgtgagctggtgtaatgtctataaggtcggcaacggtttcttgtgttacgccctttttaattcttgcaattttaatacgctgtccgattgctttgtaatcaacttccacagtttcctctcctttcctgcttttttatattgtaaccattcgcagagtgtaatataatactctgtgtaaatgaacaattctttcagtatatattcaggctaaaaagtttaaaatatggaagaatataaatgcaaagggggtatgtctatatgttaagatttcgtaaaaaggatagcaaagagcttataaaaagaatggctaaaacaaatggctgttcggtatctgaaattcgcagagaaatgcagtatgctattgatgaagccagaaatagtgatgacccaaacaagcaagcggaatttcaacgcttatttggaaataagatacccagtccagaagaatttatttgtgtagttagcaagaatttaaaattttagtaaatacggagcatgaacaatgaaaaaagcagaaacgcaggaacaagaatttttagaagtttgttcttcttacgaccatgaccttttaactggaaaaaaagaaatgacattgaaagactatgaacgaattacttatttagttagttctcttgggtatagtcaatatcttcaattccttattggaaaatatatggacttagcacacgctgacgaagaacgagaagaaagagaacatgaaatatatttggaatatccagagtattatgaggacgagggaattttagaagaagaagaaaaatggctggaagaatttttaaatcaacttccagagaagaaaagagaatattttgaaaaacttataaaagagagttaaagctactaaaaaagttactgtattcagatgttctgatcacagtaactttttatcattatacaagggaaaacaaatgctaatagacaaaatatttttttcgtaacttacattttcaattttaccgtcaatctttttcagcaattcctttacaatatacaagcccagaccagaacttcctttggtgcgtgatttatcaacagtataaaacttgttagcaattttattcatgtgatttcatctcctttaattagacattgtaccataaggtttttatgctatccacatgaaacaaagaagtctatggtacatttagaaattatttagaaatatactttatgattttggaaaataattttgatgtgtaaattagggagtatgtttcatggaatgttttaaagaaatttatcggctataaatggaaaaagcaatcaacaaaatcgttaattagatatataaattcattcgctcgtgcaaacagtctgttttgtgcgggcttttttcattctggaaaaattttggcttttttgagttctcaacttaacaaatcacacctgccgttccctatatggtgcggaaagagggagaaccacttttcacgtcatagcggaaagggggtgagattgatgaaaccgtctgacttccagaaaacagttcaatgccgttttgaaagttgtttgaagaaagttgtccgtcatgttgttaaggactaccagcagaaattaaaacgacgacaagagaaagaaacgctcttttgcgaactcccagaaatcgttgtagaaaatctggctgtctgggacgattatgaaacggactatacgattttcaatgtatgcggtcacgatattcgtgtttatgatgatgaattggcagaagccttgaaacagttatccgagcgtaaccgtgaaactttgctgatgtattatttcttggaaatgaacaacgaagaaattgcaaaaaaacagaatatttccagaagcggtgtattccaaaatcggcacaactcattggcacttatgaaaaaattactaaaggagaaacagtaaaaatgaaacaaatacttaagaagccgtcctactatttgctttcacaagcaatggacggggacgaaaaagcgattgaaaagatactggcattttatgacccgtacatatcaaagtgctgtctgcgtccactctatgatgaatacggcaatgtctatattgttgtagatatggagttaaagggacttatcagagaagcacttattaaaatgattttagggtttgatattgccttagaaatcgaagaagaataacaagcagtaaccgcagagcatgatttgttcaatcccctctttcctgctctgcacctgcttttacatgaaagtaacacgctttcgccacagctctttgataactgaataaagcagacagatacgtttgtgagatagcgagccacggggactgtacgccacgaccttttcaaaagaaagcgagcgacccacgcagtgatccgagagcgactgttggaaaagtcgttttgccacgacctatcctcacagaataatgatacgtccgcatggtgcggttctgcccacaggaatgggaatagttgagatactaacggagctttccaaagccgtctgtctgcttctgtaacattgtgaaaaatacgcatattggataagcctatgtgcgtatgttgagaatagatagctgactaaggaggctgataacttggctaaaaaagaacctgcacaatatatcgtagaacgggaatttttaggtaaattttccgtagaggaattgcttgtccgtatcgtgaaatctcatgtaaaaaaaggactatcaagagggtaaaacccttgaaaacaatggaaagaagccgtactttatggtataatattatcataggtacggcagttgaataggtggaaaaatgatttatcaaaaaggttcaaacttatttaacgtggctatttatatcagattatcacgagaggacggagataaggaagaaagcgatagtgtaggaaatcagagaaaacttttaacagaatatgtgaacaagcatgatgactttatcttatatgatgtttatattgatgacggttttacgggaacgaattttaatagaccagactttcatagaatgattgctgacattgaagataacaaggtaaattgtgttgttgtaaaagacctttcccgtttcggacgagattacattgatacggggcgatatttggaaagaatatttccagagcttaatgttcgttttatttctgtaacagataatattgatagtatgaagcaggcatacgatatgttacttcctattaaaaatatattcaacgaacagtatgccagagatatttctaataaaattcaagcgactgtaaaatcaaagcagaaagcaggggaatttatcggagcttttacaagttatggttataagaaatctcctgcaaataaaaataaacttgtgattgatgaatatgcgtccgaagttgtaaaaagagtatttactatgtatgcacaaggaataggaaaacaaagcattgccaaaatactaaatgcagagggtatcctttgtccgtcggaatataaaaagctcaacggcgaaaattacaaaaattgcaaccgtttagagaaaacttcttattggacgtattccacgattaaagtgatgttacaaaatgagctttatattggaaatatggtacaaggaaagaaacatcaacgtatgagaagtaaacagcgtccagttgagaaagaaaactggataagggttgaaaatacacatgaaccgattatagaccgtcaactgtgggataaggtacaaaaactgctgacgaaaaaacatagggatattgatttagaaacaaataaaaatatctttgcaggttttatcaagtgtggcgattgtggtcgggcaatgatgaaaaatttctggcgacgtgctgacggaagtaagtcctattcattctattgtggaacttacaaaagaagtggaaaagattattgcactccgcacacgctcccgtttcaagtattgaatgatattgtgctgggagatttaaagcagattatccgcaatgtagagaacttgcaggaacttgtaaaatcacaatctttcacagcaacaaaaatcagaaaatcaacagacatagaactgacaaagttaaaagcagagcttgaaagagtgaagaagttgaaaaagtcaatttatgaagattacaaagacgaactgatttctaaagaagaatttctttcttatcgagaggactatcaacaaaaagaaacgctttactccaaacagattgaaacgctggaagaaaagaaaaaggaaaatgtaacagaagatgtttttgaaacaccgtggttaaggcggttgttggaactgaaagacattgaagaattagacagagatattattgtggaaatgatagaccagataacagtttatgaaaaccgcaaacttaaaatctcatacaacttcggaaatgagctggaacatttattttcaagcgtttactgtgaagacttggagaaaaaggttatctaatctcaatacatttctaactccccatatatactggggaatacatatcacaatttgcgtaaactacaaccagcacacggaggacgtgatccgggagctgtgtataatggtcgccaggaaaaggatgatgtactgaagctggtgcttgcgatcggagaaattttacaaaacagcggaattgatgtggaatacacacggacaacggatatttatgagacacctttccagaaagcaacagaggcaaacgaagccggtgtggatttcttcatatcgatccaccggaattccagtcctcttgccaatcagtacatgggtgtggaaagcctgatctataacctttccggtatcaaatatgagatggcggaaaatatcaatgcacagctggagacagttgggttcaaggatctcggagtaaaggcgcgcccaaatctggttgtccttcgccgtacaaaaatgccggcgattctggtcgaagtcggttttatcaattccgattctgacaacactcttttcgataagaacttcaatgatattgcgcaggcaattgcagatggaatcctggatacgctggaagaaaaagggctctggaaaccagaaggcgcaagaaacagttcgaccgcatcggaatccggaaggacttcttctgacgcagatacttctgattccgtttctcctgctgacggttctacaaaatcagatgttggtaccctgacaaattcaggctcagtccctgattctccttgtacgtcagactctgctcacatgaatccgtctgatgaaaatacagactccgaatttcctaattcttctccatctgtaacctacagtgtgcaggtcggtgcattccgaaatccggcgtatgccagacggcttcttaatgaactgaccgaaatggatttccctgcccggattgatgacagcagccagtatgaccgggttctggtcggtcagttcgatgtattgaatgatgctgccatgatggaacgaagactaaaacagagcggatatccaactgtgatcgtgagtttttctgaagaagtctgattgattctgcaaaaaattcatacattattctaagtgcaaaaataatattgttactgttcacagtcaatatcatttatttaggaaaatttcttatcagaaaaggaattttcctttttttaccagtaactcaaaaatctcttcttcttttgctgatattttccgtgatgaaaaagatacagaaacttattttgaaccaaacaataaatctcccagaggttttaatcagatccacatcaatgcactttaagccaagtaaaaagaacagaaaagattctcagataccaaaatcttttctgttcttttttgtatattataaaggatagattagtacctcctcggaggtcatgtattccccttaataaaagggcttatttcattatgggcgaatgctctttgccagttctttcgcttcttttgtcagcttacagattttctcgaattcgccgtttttgatcagatctgcttttactatccagcttccgccacagcagatgatcttgttaaattccagataatcttttagattctgtgttccgattccacctgtcggcataaaacgaagctgattgtatggtgctgccattgctttgatcatagccactccacctgcaggttctgccgggaagaatttaactactttcagtcctctttttactgcctgtgccacttcagacggtgtcacacatcccgggaaaatcggaatttctttttccagacagtaatttacgatttcaggatcgaatccaggacttacgatgaattttgctcctgccttaacagcagcatttctcatagaatccgttttccttgagttcctctaagttttctccaagcctgtaaacgaacctgtctatcagttccttgatagaaaacgcgctgaaagaaaaccataccttgtttacatgaccgctggtaccaataaattcttacgaatctactatggcaaggttaaggagtgcttacgcaacttagagcaatctcaaatcgaagagtcttaaatatcaaacgattatcacctccgttaagctagccgttttgggtagcctatttcttgtgcctatttttcaactcttaaatttcttcaaaaagtacttgactttttattagtaggctttcctgccgaaaatataaaaaccacagaaaagatacgttaatccttatttgtgtcatttctcggggcgaaaatcggggtaaatatccctttctaagcctttcaaaaaagcacataagttatttgtactaacctgtggttatgtattgaattatgggttttgggtaacaaaaaacaccgtatttctacggtgcgttctgtcagatatattctgttttatgatagcagaaaactggataattcttctttttcagcagttagatgctctttctcctgctccaattcctgtacttcctttttccgttcttttttcttgaagttatagacatccagatgttcctcatgagtacctttctgttcccattcaattccatactgctttgcagtctctgccagaacttttttttcatgattcatccactgattcagttccgtatcatgcttatttccaccttgaaatccaagactttttaatgcctgtttcagtgaaactctggtatccattccttttcctttccagcccgtcacataaggaataaagtcaatatggagatgtggagtagcctcatcctgatgcagatagcaactaaatacccgaagtgtcggattccgtttctggaaatcttttacatactcatccagtacgtttacagccagatctcctgcttctgttccaacagccatatcttctcggtttccaatctggaaaatcacttcatggaacaacttttcctgttttccttggcgaatcttttcataataatttgtaatctgccgatcttttcttttcccgacattataccgttctacagcttcatcaaacagctctttatagacttctttcagattctcattccggtaacaaatatttaattgcactttgtctggatcaacattttctgctataaaatctcgtctgttatgagccagagaccctgtcccgatcataccactgattgttcgtttcatcgtcatattcctcaccccgctttctaaaaccagtgccagacatggcacataaatttgtatctttgccagctatagtataaaaagaaatattcgccggatacggcggttttgttacttttgtcaaaagtaacgcaaaagcactttcgacagccgtaccgtccatcaaaagtacccttgcgccctccgggggtacagagacctttactccggtatccttgcccgaatatattccaaatcaccacaatacggtgtccctacaagataccattctcttgcaggattcatttccattctggtctgaacccattcatcatcaagcaacacttccaggcattctccacagtgaaatcctgtatcaatccatagatctgatgataataatccatatcttttgttataactgttatatcctaatcttccttctctcattgtgccaatctcctttcatctaccgtttccgcaggggcgccctgaatcagggctcccttttgaaaattctcttctacgccagtcaactcccgactacaccttaccaacattctccttgtctgctatctacaggtgcgtgacacgctcctgtaataaagtgttcagaaagaacctttaccatcgaaagttctccggtattccccgtctgtccagatattcctgccggaacttttctctttcttcttccgttggtgctgttttggatttgctgtatacttcacgattcaccattgcatccagttttttctccaatcccaaccggattatttcttcgccatcgtagttatccatcaaaaaatattgcaagagctgaaagaataactcgtatggaatctgtacacttttattttgcatctgttctcctttcaaggtagcaagattccctcttcttaagaaatggtaatcttgccatcttccatttttattctggcaacatccaataccattgctttccacgttttacggaatcaatttcaagttcccgtttggcgttccatagcgttttacttttgattcctctggcttctgcttcttctgcaattttcttctgagtcattcctccatttgccagtatctcaaggagaaattcttttgctttccgacttttctgtcctcttccgtctccattaagaagttcatcggcactgatatcatattctccaatccattcaaacccattattcttatccagtctgaatgcaatggacgttccttccggtgcaagagaactcttcgtatgacataccactcttacttccggttcatctttcactcgcccgacaatcagaacacttcttgcagcagcctgaaaatcaatggatccaagtcctcgataagaagatttgccgttgctgtttttgttcatatgaccgattaaaatgactgcacagtgatatttttctgacagcactgcgatacgcttcatcagtggtctgatctcatttgccctgtgcatatctacgtccgctcccagaaagccctgtatcggatcaagaacaaccatttttgcttttgtctgcacgattgcttcttccaatctgacatctgccattgtcagtggctggtcactgtcatcaatcaccagcacctttgaacaatctgcacctgcagcaagtaatctgggtttgatagtatctccaagtccatcttctgctgtctgatagattacatttacaggtgacacagaagactgttcctgcatattatcttcagcatctaaatcttcattctcactatcgacttcatcacctcgtttttcttttgtgttcgttgtatcagtaacaggaagaatcggctctcctctggtcagttttgcaataatctgaagtaccatcgttgtcttgccttctcctggatctccctgtataatggtcacttttccataaggaataaacggataaagcagccattctacctgttccacctctactgaatccatattgatcagtttcagttttggttctattctacaattctcaattttatttttttcattcatattcattccatcatctcctcttgcccttccgggcaagtctctgatgaacagatattcgggaattgtcgtatttcccgattcgtgatatactgaatctgccaagatggtatatcagtgaatctgattatcagagaacttgctcagattatttatctgggctttttcttttgccttttcaacattcatctctttcttctcccaatccggtaacagcatttccattttcattatccagaagatttgcaatctttctctgctgatttggataaagatgtccataagtgttcaatgtgatacgaatatctttatgacctaatctgtcccgaatcaataacggttccacacctttctcaataagataagccacatggctgtgccgttacggtataataacgacaaacagaaaaagcctttattttcaaggggtttgagcgtttgtcgtcttttattcaattccttttccaagttgaaaattgacgaaaactataaagaaaaaaggaggctgttttattaacgacaaaatttaatagtgccagcggtccggctttatgtctgaccgctggttgccgtgggcgtttcacttttataggtggacgcccttttttcatactcattttcgagagaaaggagatccacatggaattaaacgaaatggaaaaaaagctgctctttcaagtggagggcgattatcagacaaagatcctgaatgaactttatatgaccgtgcggtattcaaataattccgaacagcgggaggcggcagaaggtcttatggcaaaacttcgtgttctgtcaaatgcagagtgcatggacttggtaaaagatattcagaagaattaccgtctgccctatccagcccggacgattggagaaaagatcgccgaggccagacaacaatcaggggcagaaaaattgaaggggcatgacatcatggcacttgaacgctttgatccagaagtaaagcacatgatcgtctttgatgtattgtcttacgattcccctgttggcgacaaaggcgataagatgcgcttgttccttacagatgccggctatcagaaatttttagagagccaggaacggggcgaagtgaaactgaaaaaccatgcgaaggtctctgacggtcatctccattatgaccgcagggatcatgccttgtaacggaatagtcgaagaaaggaggcggtacaatggcagtattccgtgtagagaaaacaaaggactttacgataatgagcaatcaccatctgcgcaatacggagttgtccttaaaggcaaaggggcttttatcacttatgttgtcgctgccggaagattgggattataccacaaagggactcgcccatatctgcaaggatggtgtggattctatcactactgccctgaaggaactggagcggcatggttatctcaccagacagcgcctccgctatgataacgggcagttgggagacattgaatatacgatccatgagcagcctgtaagtaccgaaaacacagggctttcacctaaacgggaaaatccaagacaggtaaaaccagaacaggcaaaacctaaacaggcggaacctgaacaggaaaatccggcacaattaaatactaatccattaaaaacaaaaaaatcaaaaaaagataaatcaataacttatccatcaatctatccggcagagccggaagcggcaaaccgcacggatgggatggatcggatagagctgatagaagcctatcgtgaaatcatcaaagaaaatattgaatatgacttactggtcttacggtatggcagggaacgtttggatgaagcccttgaacttatgcttgaagtgattttgtcgaaacgcccttacattcgcattgccggagatgattttccgagggagatcgtcaagagccggttcctgaagatcaattccggccacttagagtatgtctttgactgtatcgacaagaacacaacgaaggtcggaaacatcaaagcgtatctgctggcggcgctgtataatgccccggctacaatggacagctattaccgtgccgaggtcaatcacgacctgtacggctgttaggcacctttgggtgtcttttttcatttcatcacaggaaggaggcaaagcacaatgaaaagaaacactgtgccggtactatgcccggcgtaaccaaagaacagattcaggcagcgcgggaagctgacttgtttacttacctgcaattccatgaacccggcgtgctgaaacaggatggacctaatttccggcataaggagcatgacagtctggtatatgtgaccgggaaaaggtactggtactggaacagccgcggacggagtatcaatgcgctggactacctgatccagattcggggatatggtcttgtggatgcggttcatgctctggtaggtggcgaaatcccacaggaaccggcttaccgaagtacggcagaaatacaggtatcaaaagagccggaaaagaaaacattcgctctcccctgggccagacgttgcgcgaccgctgcggtcttctatttgcagaaacgggggatcagctcagaagtcattcgccagtgtttacaagccgggattttttacgaagcccggtatcatggagaaccggtttgtgtgtttgttgggaaagatgattccgggaaagcgaagtttgcctgtatgcgcagtatcagcggcaatctcaaaaaggatgtctatggcagcgacaaaggatataacttttgttatcccccgcaaagtccgggcagccggcatgtggcagtctttgaagctcctattgatgcgctttcccatgcgacacttcaagagctggagggatggaaatggaatggttatcgcttgtctttgggcggtacttcccatgtggcgctgacttctttcctggaacgccacccggagatacggcgtgttaccctttatatggaccacgaccttgccggatttgtcaatgcccggaaaatcaagaccatgcttcacgaggataaacgtttccgtcatatccgggtaagtgtcaaccctccccggatgggaaaagattacaatgagaaattgctgctggttcgggaacaactgcaaaccagccagcaccaacgccgcccaaaagaggcggctgtttcaatttagggaggatttcaacatgaatggatctcaacatatctgctttacagacagcgccggaaaagcgctgttttccattcccgacaatggtttactctgcctgttctatggaaacggggacaggcactttgctgtttgtcatcgtctggatgacacccatgcagaaattgacggggtaaattattcgatgccggactttgccaaaaggatgaaacacaaccagatcagctttgccccggcataaggctggaaaacaaataacaggaggatttgaaaatgaaaaaaattgaaaataccgctttgcagatgattgccgaggcttcccggtgtccagactacggccccgatatggttaaatcgctgatgaaaaagctggacatgaacgaaaagggctttgcgcttttgatgaatgttgccccatccacagtgcgtctttggaccagcggagctgcacagccttgcggcacagcaaaacgcctcatgcagatttatgaaaccggtccggagattgtcggcaagattgccggcgggcagctaccggcagatgggagggattgattaaatggcggggacagatagccagccgtttgcggaaaatgagcaggtcaaagagctgcttcacatgaaaggaggaatttgattgaatcaggaaccactaccgcagattcatttgatccgcgatacagacttatccgtctttgcgtatgaactccatatttttgccggagattttcttagagaatgcgaattcaatatgcgttctctggcaacaaataccggggctgattccattgccatcatggggaaaaatcacatgtggctttccgacgccttatttgcttattgttctacggcggatcttcatcaaatgatcttaacaacggagttcatcggagcgagggctttcctgtttcatacggatcggagcgagggcggtcacttgtacggagatgtcctgatgatggatttagacacgctgcggcaggatataaaaagaaatatcctctatccctgcggcgtcaatattgaacgcaaagatggttcagcggctacggtcagcctgaaagaatggactgaaatggagctttacgaaaaagatgctctgaaaagttggggattttcttatgccccgaatcaagttacggaatggcagtaccactattccacgatgttcagacagtggatggatcaggcatttcgttatatgccccaggatttagaagaacgcctgaatatgcaatatatggaggcagcccagaacccggatatggataagtaccgcataccacagggaacggcaaagcagatgcttctttatgacgaagcccctgtgtatcgccttcttccatccggttcggagaaaattgcgcccatcgcggcaatctctacgggcctgtggtatgaaaattaccgggagtttgccattgcaccggaggatttaggcgctctggacaaactgatccgcagggaaactgaccggctcacaggaaacctcccacaacttcacaaaaacgaagaacgccgccctgccccggagcgataagaattttacactgactggaggtgatgaagattggcaggagtgcatgaagatttcggcgaaaagatcggcggtgcgaaaaaagacctgtggaaagaccgcgggctgtatgcagatgatctggaagccatgaatgagcgcgaagccgaaaaatttgtgaaaaaggataatgtttggaaaaagccggactatgcagccatgctggaggaagggattcctcttggcgtggtctattttattaaaaaagcaagagacggcttaaacgcttcccctcagtattaccgcacggatgacaccccggaaaaacggaccgcgagacaaaaggaatatataaaaacagtccgggaattgcagacagtgctttcagatgtccgtactgtggaggatgctgtgagagcctatgaccgctttttcgttgacaatggatatttagaaaaggtacagggctggggaagcggaatccattaccgggcaacgaaaaagggacaggacaatcccgtgatcacaaacaaattgtccaataccatgctgatccgctcagctgaatattttgagcgcaactttactcaggaagcaaaaaaggaacagttttgtgtttccaaagagcagaaaataccgaaaggttatgcgatccacttcaacgacgggaaacagacctattctaaaaatggggactggaaacccggtacctactatgtgacaaaaggctattcgatcctgcggaccaattttgggaccaaagaagctgccctgaaatgggtgcaggaacttgccaaaggcaggaacaaaaacggaaagatccgttttgtccctccacagcttgcccatgtcaaacgtaccggaccggattatcggaatggcgtggagatcaccggacagcattatcttgatacctttgggttccgcggcggtgagtttggaaactggatgaaccagaacgaccggcagacctcccttaacatgggatttgaagcactaaaggatctggcgtcagcccttaagatcagcgataaagatattgcttatcagggaacacttgctatcgcttttggtgcaagaggcagcggcaatgctgcagctcattatgaacctttgcgtacagtcatcaatcttacaaaaatgcacggggccggttccctggcacatgaatggtggcatggacttgacgattatcttggtacaaagatgagagcaaaagggatgctgtcagaacagccccacctctatgcgccgttccaaaaactcattgacaccatgaagtataaaccggaaacaccggaacaggcagcaaagcgcacggaagcacaaacagaacgcacccggaaaaatgcggcaagctggctggattcctcggttcttgcctccctgaaacggtatggcaatgaggaacagatggaaacctacgcagtcttgcgggaagcatttttgtccggcgaacccggctctgtggaacagatcagcgcatttaagaagaatgttaccggccgggtaattcccaaaagtgaacgggaacggctggaaatttttgagcgtatgctttccgggatgcaggcgcaggaagctccgcagattggacggacggaaactgatttttaccgtaattcggtacgcatgggaaaagaatgtgaaaaagacggcggttattgggacagcaatgtggaaatgacagccagagcctttgcctgttatatcaaggacaaactgccctacacatcggattatctggcaggccatgccgactgtgcccttaccctggtttccggtaaagacggagaaatggaggtattgaaagccttccctgtgggggaagaacgccgtgcaatcaacgctgtttttgacgagatcattcaggatttgaaacgggaacagctattgacccatgccgatgtaacgcttcccctctctgtttctgaacttcgtgaggcggcggacgggcagctatccatgttcggcgtcggccgtccttccgtgatggatcagcttgcggcaaacaggccggcagataaaaaatcaccggcacagacgttttccagaaaaaaccacgagccggaaatatagcaggaggtgaacagcattttggaagaaaataaagattatcatgcctaccggtatggcgaccacttgacgccgggatcagagcttaaaattgaacacagcgtagtttgtgaaaatgtggatatttctactctgatcacaatgggaatagatagcctggaagccatgcgccagggaagtatcgacggggagcagaaagcctatgaaatcgtggtggctgctgcaaaacaatgggaacagcaggcagcggcaacacagacgatcaaccgggctttggaatatcttcgtacaccggagattgaacataccggcaaccagtggaaagacaccgataactggagggcggatcagaaaatcagcaaccgggtctatcagatgacctgcagtatttgggaagatacgaaatatgacagagaaaccaaacagagtgttccgattgcctggtatgtgacatgggaagtccgtattcattccccgaagcagggatatggagcaaagattgccggacaaaaccagaaacgatatacagataagaacgcagccataaaatacctggacgggcgaaagaaagcctattcccatttattcacggaaatttccccgccgatcccgaaagaatatgagcaccattttatggttcacggtactcttttacctggctatacggttgaaggactggaacaggccaaaacggaacatgccgccgccgaggtttcggagggcggtatttttacacccgaaaaccaggagaagccttccgtcctggggaagctctctgtggcaaaaactcaggaaaaaacgccaaccactcccggtacggcaatgaaaaagaaggaggatatacaattatgaaagtgttaatggtagagccgggcaagtccccttatgctgcggagatcgaaagtggtctgaaatccttgcaggcggcagtgggcggagatattcaggcggtctatccgtatgaggacccggtggctctgatctgcaatgaagaaggcaagctgatggggctgcctttgaaccgagctctctttgacgatgacggccacatctatgatattgtgtccgggaattttctgatcgttggtcttggcgaggaaaattttacagacctttccccggatctgatggagaaatatggggagcagtttaagtaccctgaaaaatttgcaaggcttgccggcgagatcattgcagtcaagcagcctgcaaccaatgagcaccgggaaaaaccgatgatgcaccattccggcccggatttgtagaaagaaaggagccaattatgttaatggcagtaaatgaaccttatgcccttatggtgcagccggacgatattctgatctctccccgtgaggtagatgaacattttgggacgatggtatgctttcatccccgctatgcgctgggcgaccatcacaaccatatggacaaagatgacttcctgcgggaaatgtatttagataccgtaggacatgatgaagccggcatgaaacgctatgaacggatggtaaacattgtaagcagccgtttccggcatggaccaaagacagaggaacgggcgatcgatgaagcaatgcagaaagtaatttcggaaaagtatctgatgctccccctctatctctacgaccactcaggtcttgccatgagtacagaaagtttctcaggcagggctcctcatgcagaatgggacagcggacaggtcggctggatctatgtttccaaagaagatgccctaaaggaatttgacgctgacaagatgaccggcgccatccggcagaaagcggacgcactgatgcgcagcgaagtcgccgcttatgattcctatctgcgtggcgaatgttatgggtttgagctttataaaaacggggagctgtcggatagctgctggggctttatgggtaacttttccgatgtgttgaaagatatggcggcatacctcccggatgagtgcaaagggatggtcgatcatctggaggaacaggaacgcccggctacgatcatcaagacgcttttgaaacatgctaaaattcaggtcgatcaggcagcaaaagcctttgaacacgcttcccgacagcaggttcttggggaaagccggtaaaaagttatttccatattataaataccgattttatcagaaaggaggatgctcttgcaggaagaactcgaacaacgaacggtttctgtttctatacaggcagcaaaactgtcagggcgggtactgcgtgcggctattgctgcggtactccaaaagatggaacaggaacgcacaatgccaaaagtcgggcgcaacagcatgaagcggctgacttataaagaccccggagccaataccattgaagtttcagggcgaatccgctcttttgaacggtatgccagaaaacatcaggtacgctaccatatagaaaaggaacttgggaccgatcccccaaaatggacggtatatttcaaggcaaaccaggcggatgcactgacggcagcttttaaggaatatacaaagaaagaccttacacgcagcaccagaccgtcgctgcttatacagcttcataagttcaaagaactggcacagtcgcttggccgtgaccgtgtaaagaacaaagaacacggaggaccggaacgatgaagattgatgcagaaacattgaaaaaacaggtcattctccatctgccttatgttctgttccttctggtatttgccaagctgggcgaagcggtgcggctggctcccggagcagacgcttcccaaaagctgttaggactgtccgaaggctttgcccttgcgtttcagagtatgtggccgggggcggcaatggactggctgatcggtttctgcggtgcagccattatgcggctggcagtctatcttagagggaaagacgctaagaaataccgcaaaaatgtggaatatggttctgcaagatggggaaataaagccgatattgccccgtttatggacccaaatccggaaaacaatatcattcttacccaaagtgaaggactgatgttaaacggaaggcccaaaaatccggccaatgcaagaaataaaaatgtactggtagtcggaggatcaggttcgggaaaaacgcgctttttcatcaagcccaatctgatgcaaatgcacagttcctacgtcgtcaccgatccgaaaggtacagtccttgtggaatgcggaaagatgttgcagcgaggcacaccaaagctggacaaggacggaaagcctgtgcgtaatgaaaaaggaaagatcatctatgagtcctataaaatacgggtattcaatacgatcaatttccagaaaagtatgcactttaacccgttcgcctacattcattccgagaaagatattctgaagatcgtcactaccctaatcgccaataccaaaggcgaaggaaaagccggagacgatttctgggtcagtgcgactcgttcgcaggcggtaaaaagtctgcgcacgggcaacggttttccgttgttcggagaactgatagtttgataggtggaatgacggggtaacgccctgaaacgcctacccttgatgggcgtgcattagctgtaatggcttttgtacgaagccccatgacaaaggctgagagtaaccgtaaccactgccaaaagtggtcgaaagtggtctggcggcagactgtgttacctataggccgagggtctataagatacctatggttagaatgttcgctttggcgggcggactgacgaacctgcgaatgtacaggtctaaaagaaaaccacgcagaaatgcgtgggtgcgttaaagcgcagtcggtgtggtttagtagaaattgaccctacgaacgaccatgctgtgttacaggcacaggcaagccgacaggcctatagcaggaacctaagggtatgtatgtacagatagagctatcggaacgaggaaaggcagcagattccgtaaggaatagtctgacgaagaacaataagcagacgaactgctgctgaaaagcagtggtcgaacctatgatgtgcttgcgttatgtgagctacggaggaatggccacaagtcggttgagataaacaggcattattcaatccaacataaggattcgagtaagaccaaaagggtcactttcgtaaaaggaggtgatgccttatgccaaagaaaagcaaaaatctatgtgtagacgatttacggcacgccgagtattacggtatgcagccagtttttgacgaactctatcgccgaagtctggacggagacaactttaccgaccttatggatataatcctaagccgggataacattcttctggcatatcggaacatcaaagcaaacggaggaagctacacagcaggaacagacaacaaaaacatcagtgacatcgggtgtttaccgcccgaaacagttgtggagaaagtgaggtttattgtcacaggaagtcagcacggataccgaccaaaaccggtcaggcgtaaaaagtccgtcggcatcggcaagtgttgtaggattgaagaacccttttataccgatgataccattccagtcggttccgtgcatgatcgcaaatccgaagatgaaaaagaacaaacttccaagtacaaagtccatcatatttttcatcagtatatttccagtattttttgctctggtaaatccggcttcacacattgcaaatccagcctgcataaagtaaacaagagttgcaccgacaattgtccagataacattaagcagtagttcagtggcggcggttgcatccattccgcccgcaattaaatcagataatcccatatttaacatcctccatttcaaataaaaaggatagctacaatgaatgatctacaggcagttcatttgtagttatcctctttgataacgatattcaacactattctaattcacatatatttttagctaaagagcagcagagccacgttcaccggtacggattcttacagcatcctgtacttcgtaaacaaaaattttaccatcgccgtacgcaccggttttgatctcttcgacaattttccgaatcagaggttctgcaacttccggttcaacaacagtttctactttgatcttaggaagaagatttacgctgtattcagcaccgcgataaaattgtttgtgtcctttctgattaccatatcccataatgttactgatcataataccgctgacattggaagcatccaggattgttttcagggcttccagtttttccggctggataatgatttctagttttttcataactgagtccctccttctcgatttaaaaaaagaacaaaaaaggcgttccccggataatagggaacgccgtcgttcttgatacgctttattatagcgactgattttgatttgtcaaattatttttaaaaaaaatacaaaaaattcgtgcatttattaggtgttgacggataaaatgtcatttgctagaataaaagataagtgaaaaagattcctttatcaagaaagttttaagttaacaaagcaataagtctgtatttaaaaagaagatatatttatacggggagaaaaggaggaaaaataaatgattagtctcacattcggagagcaggtaaaaattgttttaagcagaaaagatatgacgattaaagagcttgcagaagaaatcgaagcaagaaccgggaaaaagatgtcccgtcagaatctgacacagcggcttggcagagataattttcaggagcaggatatgcgtatgatcgcagatattcttggatgcccgttccagctcagcattctgggtaatgcggattcggaaaaggaggctttggatgaagaagagatgccgacgggaagagaacttgagaagcttaccgcgaaaaaagaaagaaaggcagcaagagaagaagcaaaaaagaatgtagaacgtgatattacagttggagagattgtagatatacttgaagagacaacagcagaaccggagaaagaagctgtacagatggaactggatcttgatgcagaagaacatgctgccaaggagacggaaagcattgcggattcagatactttggaagaagatattctgactgaagaagaaacagagccgtacacagaaccggcagaagatgatgtggaagtatctgcagaagacgcagaacagattgaagaagaattacaggagcccgaacaggaaatagaagcggaagtggttgaagaagccggggctgaggagattccggaggaaacttctgaagctgcttaccaggaagaggcagaaccgcaggaagaagcgtaccaggaacagccggcttatgaagagaatcagccggaaacctgtcagaaagaggaaaatcctgtagtagaagaggcggaaactgaagatgttcatgaggagaaaaattcaccattttcaaaacttacaaagctgattactccgaaaaaggaaaagaaatcttccggatggccgcaggatttccagccgatcaagcgtcgggaggatattgatgaagatctggtaaatggagatgtgaacccatataccggacatgagtatcggacaaacagtgtgcgtatgcatccacacagaatcggttatgtacaggtatatgaccgaaaagatcacaagtggacagacatgacagagtgggcgttccttggggtggaagagcgaaagaaagctacgatgggaaaagactacgagccaccgatttatctggattaatcaatgagttatttgtcagagcggaagattccgctctgattttttaaaaatggtaatttttaccggaaagtcagaatagtttagaacaggcagttagaaggaaggtgcaggtgctagattatgaaaagctttatccggtatttatatgaatatcagaatggaaaaaggacaagaaatacaggatttgtgaaggttcttgaacagacagatacagcggaaatccagatttatgggagaggatttccggtggcaggaggacgtacactggaaatatatctcttttatgaagaggatggcaagtgtattggaatccggatgggagagatcagaggggcgcaggcagcatttggttataagctgagttatacgacagacgatgtgggaggagatggacagtttggcaggattggtggaatgatccttcgggctggaaacggagcggatgcaggatattatggagcagtctgggatgaggcgagaccggtagatgttagcaggatgattacggaagaagaatggaagctaaacaaatcggggaaaaataaaaaaattgcaaatggcggagacgtgctaagcaatgaaaaatacgagaagccaggaaatgagaaaatacttgaggagaaaacaagccagagaaaatatgagaatatagaagaacaggagacctcagaacaatctaaaaacacagatgcagttaggaaatcgaaaagcaacccaaatgtgccggaagaaagaaactctcagaacgcaaattcagatttaccaccaaaaaccacaaaggatatcatctataagatcacccgtcaggagcttgccggacttccgcgaaaggaatggaagcttgcgaataatcattttctgctccatggatattataattaccatcatctggtatcatttgaaaaagaagggaaatgctggattggggttccgggactttatttttcgggcgagcagcgggcggcaggagcatttggattcagtcagttcatgaagccatctgatggcgaactggatctggaagaatatgagattgaagatgaggaacatttcggttactggtgcagaccggtaggggcagtgattcgaaaagaagtaaaggagaaggaagatgcggcagatattgaccgaagacgaaaaatacatgaaggaagcgatccgtcaggcgaaaaaagcatggaagattgaggaagtaccgattggttgtgtgatcgtatatcaggggaaaattatcggacgaggatacaacaggcggacaacggataagaatccccttgcacatgcagaaatttctgcaatcaaaaaggcaagtaaggtaatgggtgactggcggctggaagaatgcaccttatatgtaacgctggaaccatgtcagatgtgttccggagccattgtacaggcaaggattccacgagtggttgttggatgtatgaatccgaaagccggatgcgccggttccatcctgaatcttctacaggtggaagcgtttaatcatcaggcagagcttacgacaggagttctggaagaagaatgctcacagatgatgaagagctttttcaaggaactgcgcaagaagcagaagatgaaaaagaaagaacaggaatcagcaaatatgccggaagaaaatccttaatcgaagaacctgtcaaaggcaggcttttttgcatgaaaaaagctacggaagcaaaatccgtagcttttgtaatttcttttttctgtgcgctgtgcgtcgaactaaagcctaccaaacgttactctggctgtaaactcaatccaggctaccttacggcacccgagaggttctgcttagtgctgcttcgttcccgacctgacacggttcacagagtcccgccgcgtaagacccaaatctcaacgccacaaaccagaggcagctttgacaagtaaagccctcggcacagcatcacccccactatagcggattgtaggtacagggtaccgctagcaccccggctgcacagaacattattttaccgtgtttttgtaaaaatgtcaatgtatctgaggagattttattttatcattttggtttacgtcaatctgaaaatggagtatgatactaaagataaaactttttggaaacggaaaggaaacgatatgaaagtacttttaggtgcagtcaatgcgaaatatatacattccaatctggcagtctactgtctgaaagcatatgcggaaaagtatggtgatacatcagatgagatcagtattggagaatatacgatcaatcagcagctcgatgagattctgcgggatatctacaaaaggaagccggacatgctctgtctgtcctgctatatctggaatcttacttatgttgaagagatctgcagggagatcaagaaagtgatgccgcagatcatcatctggataggcggaccagaggtatcttatgatggagtaaaggtgctggagcgtctgccagaagtggatggcgtcatgaaaggagaaggggagcagactttctgcgatcttttacacttttatcaggacaagacagtggacggacttcagaatatgaaaggaatcgtataccgggaacagaccgggcagattgtggaaaatgaatggcgcaagaccatggatctgagtaaggttccgtttgtatatgagaacatggagctttttgaacataagattatttattatgagacaagccgtggatgtccattttcatgcagttattgtctttcttctatagataagtgtctgcggttccgtgatctggaactggtaaaaaaagaactgcaattttttatcgatcataaagtacctcaggttaaatttgtagaccgtacatttaactgcaaacatgatcacgccatgacagtctggcgttatatcaaagagcatgataacggcattaccaatttccattttgaggttgcggcagaccttttgaatgaagaagaaatggaattgataaaaaccatgcggccagggctgatccagctggaaatcggtgtgcagtctaccaacctggatacgatacgtgagattcaccggacaatgaaatttgaacaggttgcagaagtggtaaggagaatcaattcttatggtaatgtacatcagcacctggatctgatcgcaggattgccgtatgaagattatgaaagctttggaaaatcctttgatgatgtttatgcactggaaccggagcagctgcagcttggttttctgaaagtactgaagggttcttatatggaagagaagagagacgattacggattggtttataaaggaatgccaccgtatgaagttttgtatacaaagtggcttccatatgaggataccctgcgcttgaaagggatcgaggaaatggtggagacctactataacagcaggcagttctgttacacgcttccttatctgatccgacactttaaaagaccatttacgctttttgaaaagctggcagagtattatgaagaaaatgggctggatactttaagtcatgcacgcacggcaagatatgagatcctgtatgattttgcaagattttatgatgcagaaagatgtgaggcgtataagcagcttctgacactggacttttatctgagggagaatgcaaagagccgtccgttatttgcaggcgatgagcggatttccaaagaagagttccgcctgttctatgaccgtgaggatgaagagaggcgttatctggaaaattatgaaaatatggagaagcggcagcttagaaaaatgacgcacatcgagaggttttcttatgatgttctgggggatatgaaagaggaagaatgtgtgcttctgtttgactaccagaaccggaacccactggatcatcaggcaaaggtattttgtgttacagaagaaatccgggaattatgcaaacagtaacatctgacagtagtaatggatatcttgaaaaaagaaatgaaagagtatagaatgaaaacaaatgtgtgatttgaggtgaaaaaaagtgtttaatccaaaacagacacggaagatagcggcagtgattattcttgttgttattgttgcaatggtagcaacatcaattattccatatatcatataaaatcaggaggatttttttgatggcggcacgaaagaaaaagagagagttaagtgaaaaggcacaaaagcgtatccgacagagaaatctgcatgtggggattacggttattgcagccatcgtgattattttctccgtgattcagttcacattatggcggtatgtgagcaaggtggatgaggagcatatttgcaaaaatgtttttatagggaagacagatgtatccggaatgaccaaggaagaagcagtgaaagcggtaaacaatacacttggagattatcggaacaagcaacttgtactgaaggtaaaagatcagggcgcagatgtgtcaatcgaggaaatgggagcggaagtagaaaatattgataagcttgcagaaaaggcggtcggatacggaaaaaatggaagcatctggagccgctatcagaagatacataatttagataagaagaaatatgtcatagatgaaagctttaaagttgatgaagcaaaactcagagagctgatccaggaacgtgcggttccgctggaacagaaagcggtcaatgcatcggcatcctataacggaagcggattcgatctgacagatgaagcagaaggttatacggttgatgtagataaatctgtgaagaagattaagaatttcatgaacaaaaaatggaattacgaggacgcagaagtagagttaaagctggatacggaagagccgacgatcaaaaaggcagatctggaatccctgcaggatgagcttggctcttatacgacaaacgccggatggggggaccgcgtgcagaacatcaggcgtgcaacggagctgatcaacggaactgttgttatgccgggagaagaattttcagtggaacaggccacacttccttacacagaagagaatggctatgtggcaggaagtgcctatgagaacggacagattgtagagagtatcggaggtggcctgtgtcaggtatctacgacgctttataatgcggttctttatgcggaactggaggtcacccggcgtgcaccgcattccatgagtgtcagctatgtagaaccatcaagggatgcaatgatagcggaaggaatcagtgattttaaatttgtcaataattacgatacaccgatcctgatcgaaggatatattgatggcaataaccagcttggtttttatatttatggaaaagataccagagctgcaggacattccgtggaatttgaaagtgagactctggagacaacggagtatacgaaaaagtatgtagaagatacggaaagtgcggtcggctcacaggaaacagagggagccggaatggatggaagcacggcacggctctggaaagttacctatgaaaacggagaagaggtcagccgggaagtaatcaataacagcacctatcagacttctgatgttaccgtgaaagtcgggacaaaatcagataatgcagaggcaactaagctggtggaggaagcaattgcaacccaggatcaggagaagattaatgcggcaatcagcaaggcatctgcacttaagtaataaaaagcaggcggctgttgggaagaatggcagaacagaaagaggataaaagtatgaaagcaggaagagtgtcacagaccgtctatcggcgttcggttttaaaacagatacagaataatatagaaggtatagattttttaagaccgtcacaggaggaaacctgttatatagcagatgaaagtgaagagcggatcacaatcgcaacggatgtttcattagccggaaatgaaaaagatcttggagtatttgccatagcgcaggcagtggatcagctggcttccagaggagcgcgggcatatggaatcagtgtccggattatgctcccgacgtttgcctatgagtccagattgaaagcgatgatggtggagatttcggagatatgtaaagaaaaaggtctcagggttttctttgcagatgcgcaaagtgtaaatgggatccagacgagtattgttcatgtaacagcacacggtgaggcaaaaaaagaacagctgcttgcaagcagatcggcaaaagcaggtgaagagattgtcctggttaaatggattggtatggaaggaaccttacggatcatacgggaagaaggggcggctctggcagagcggtttgcgccgggattcttaaataagttggaagatatgagagatgaaattttcagtgacagggcaatggagattgccggccggaacggggtgtcagcaatgcatccgatcggagaaggaggaattcttgcagcactttgggatatggcagaaggtgcaggaattggtctttcggtagagatgaagaaaatgacggtacgtcaggaaacgattgaagtctgtgaagtatttcatctgaatccttaccagcttaccagtacaggagcggttcttatggtgacaccgaagggtgaagaactaaaggaaagactgaaaagggaaggtattccggcagagatcatcggacacacaacagaaggaaacgagaggatcatctggggtgggggagaaaaaagatttctcgacagaccggcaccggacgaactggcacgaatttacgaaatgaaggagaatgtaaatgcttaatattgtactttttgaaccggaaatcccggcaaataccggaaatatcggaaggacctgtgtggcgacgaataccagacttcatctgatcgagccacttggtttccggttaaatgaaaagaacctgaaacgggcagggatggattactgggaacatctggatgtgacgacttatattgattaccgggattttatggaaaaaaatccgggagcgaagatttatatggcaactacaaaatcaccgaatctttatacggatgttaaatatgaaccggactgttatatcatgttcggaaaagaaagcgcagggattccggaagaaatcctctgtcaccacaaggaagacagcatccggattccgatgatcggagatatccgttcactgaatcttggaaattcggttgcgatcgtgttatatgaagcgctccggcagaatgggtttgccggaatgaatacagaaggacatcttcacagattggaatgggatgaataaaaaagtgctgcaaggctaaaaacgctttgcagcacttttactattgtgaaaaaaatgactatataaaatattttaaataatcaacgcatttaatggcatttattggtaaaagtgatgacaatatttggaaattgtataagaaaaaatacaatcgtgtgtaaatcagtggacatatttcataaaaaaggatataataaacggagagtgatatagagaatggagataagtattatgaaatataaacaaagcgtatataaaacctttgcactcatcagtcagttaggcatcagtatactggttcccattttgctatgcactttttttggtacatggctggaaaagaaggtttcttttccagtttttatccctttggtgatagtgggtgtattggcaggtctgcgcaatgcatgggtacttgcgagacatgcgaatgaagatccggaagacaaaaacaaaaattgagcagggaggaatgaaacaacatgagtaagacagacaataccgtactgaaggatatgatcatcactatgcttctgtatggaataatcgcacagattgtatgtctgattatcccaggggatcatctgagaatgacagcagggctttggatcggggtggctgcaggtgttttcatggtaatccatatgaaaaactcgttggatgaggcggtactttatggagaacaggaagcacagagatacatgcagaaatcttacgcgataagatatctggttgtagttgtagtatttatagccgtcagctggcttcggattgtgaatgtacttacattgtttgcaggaattatgagtttaaagcttgcggcatatttgcagccaattatgcataagcttttcgctaaattcaaaaaatctaagtaaaggaggtagagcgcgtggggaacagcttaggaatgctggcagctaaggagccggattttcaaattcacggtctcgttaaattccagttatttgggcaggagttatggctcaccactacacatgtcagcatattgatcgtagcgttattactgctgatttttgcgttggttgtccgagctaagctgagcgatgccgaaggcaaacccggaaccctgcagaatattgccgagcttatcgttgagatgcttgacaatatggtaaaaggaagcatggggaaaaacggactggcgttccggaattatatcgggtctttgtttttgtttttgattgtggcaaacctttcgggacttttggggcttcggccaccaactgcagattatggtgtaacacttccacttggacttatcacatttgtgctgattcagttcaataacatcaaatacaacaaaattgaggcatttacaggcctgttcaaaccattgccgttcttgttcccaatcaatctgatcggggagatcgcagcaccattttccatctcacttcgtctgtttggaaatgtgctgtccggtactgtaatcatgggacttatctatggtcttctgtataagatcgcatgggcatggccgggatttctacacatctatttcgatgtgttctcgggagcaattcaggcatatgtattttgcatgctgacgatggtatatatcaatgacaagatgccgtcagcggagtaaaaagcaaactgggatctaagttcagacagtatcaggtttgcagtgattaaggaggaaaattattatgggtaatatttcaaatgaagctttaattttagcgtgttcagcaatcggcgcaggacttgcgatgatcgcaggtattggtcctggtgtaggacagggtattgcagcaggtcatggtgcatctgcagtaggacgtaacccgggagcaagatcagacatcacgtctacaatgcttttaggacaggcagtagcagagacaacaggtctgtacagtttggttattgcacttattctcttgttcgcaaacccgcttcttggaaagctgtaaaaaaggttttgcctgtaaaataagagaaaggaggcaacgccttggaacgtttgtttaatctggatgcgcagcttctttttgatgcctgtgtcatggcactcagtatgcttgtcatgttcacgtttctgtcatatctgcttttcaaaccggtaagaaaacttctggaggacagaaagcagagagttgctgatgaacaggagtcagcaaagaatgaccggaaagaggcagccgtttacaaagaagaatacgaacagaaattaaaagaaatcgataaagaggcgcaggctattctcagtgaagcacggaaaaaagcgatgaagaccgaaaatgaaattgttgcagaggcaaaagaagaagcagcaaggatcatcacacgtgccaataatgagatcgaactggaacggaagcgtgcgcttgatgatatgaagcaggagatgatctccattgcatcagcaatggcaggtaaagtagtagcagcttcgatcgataccagtgtacaggatgaactgatcgaagagacattaaaagaaatgggagaacagacatggctaagctagtatcaaaggtatatggtgacgccctgtttgaagctgcccgtgactgcggaaaaatggatgagatattcgaggaagtacagagtatcggagtgatcctcgaagaaaatgcagagcttcagaagattctcggaaatccgagagttatgcgtgaagacaaagagcagatgatcgagacgattttccgcggacgtgtttcaaatgagattgtagagctgatgaagctgatgatcgaaaaagggcgctacagcaagatagattctgtatttgaatattttatcggacttgtaaaagaagaaaagaaaatcgggattgcatatatcgctacagcagtagaactgagcgaggcacagaaagaagcagtcatgcagcggcttcttcagacgacaaaatatgaatcctttgagatgaattatcaggtagatgcttctctgatcggcggaatggtgatccgtatcggtgacagagttgtggatacaagtattaagacaaagctgtatgaactgtcaaagagcctgaagaaaattcaggtatagcagttagaattagtagaaagaaggtggattcgctccatgaatttaagaccagaagaaataagttctgtgatcaaagaacagattgaaagatattcctctgagctgaacgtatcggatgtcggaacggttattcaggtggcagatggtattgcgcgtgtccacggccttgaaaatgcaatgcagggtgaacttttggagttcccttcagaagtatacggaatggttctgaacctggaagaggacaacgtaggtgctgttcttctgggagatcataagaatatcaatgaaggtgatactgtaaagacaaccggacgagttgtagaggttccggtaggcgactgtatgcttggccgtgtagttaatgcacttggacagccaatcgatggaaaaggaccaatccaggcaaccaggcatcgtcagatcgagcgtgtagcaccgggggttatttcccgtaagtcggtagatacaccacttcagacaggtattaaagcgatcgactccatggttccgatcggtcgtggacagagagagctgatcatcggtgacagacagaccggtaagacagcgatcgcgatcgatacgatcatcaaccagaaagggcagggcgtaaagtgtatttatgtagcaatcggtcagaaagcttcgaccgtagcttcccttgttaagactctggagacctttggggcaatggattatacaactgtagttgtgtcaacagccagtgagcttgcaccactgcagtacatcgcaccgtattcaggatgtgcgatgggagaagaatggatggagaacggagatgatgtactgatcgtttatgatgacctgtccaaacatgcaactgcataccgtaccctttccttacttctgaaacgtccacctggacgtgaggcttatccgggagatgtattctatctgcattcaagacttcttgaaagagcagcccgtctttcagatgaacttggcggaggttcacttactgcacttccgattatcgagacacaggcaggtgacgtatcagcatacatccctaccaacgttatttccatcacagacggacagatttatctggaaacagagatgttcaactctggtttcagaccggctgttaatgccggactttctgtatcccgtgtaggtggatcggcacagatcaaggcgatgaagaagatcgctggtacaatccgtattgatcttgcacagtaccgtgagctggcatcctttgcacagttcggatcggaactggatgcagagacttccgaacgtctggcacagggagtccggatcaaagagatcctgaaacagccacagtttttgtcttcatgagatatatacaaaaatatatgctttttgtgttatttatctcttgacatcacaccgctggactgtgtctgttcattcatattaacttgtcctgaaaatgtcacatcgaatcatgtgtctgatatcatatacttttcttgtgatctgtttcaaagcagagaatgtcacccggcgtatcttcagagtatttcattataccggatgcaatttcctataaaataaaattagaatcgaattagagtgacttcactatacactgacatctgccactttacaagcagaacttttttcaataattcacaaactttttgttccaaaatcagtcactgatctttttattttctataatcctctgacagtcacaaggattccctgtcttgtgcattctgccagactggttactgttcacagtacctatgaccagcaacgcatctcgccattttaaatcgcctttggcgatgggcgagatgccattcaagataaaacgtgcatcctccgtgccaatcagcgtagtgattgacacggaagtgaacagtaacccggactgtactttttcccacttgcttttcactcccgtatcgcttatccttttattgaatatatttatgaaagaaggcatacctatggctcaatcttcacatgtacttcacgaaatccatcctgtatttaacacagactcccgcattctgatccttgggagcttcccttctgtaaaatcacgggaaagtcagtttttctacgggcatccaagaaaccgtttctgggatcttcttgccacacttacaggtgaaccacttcctgccggcatagaagagaaaaaatcactgctccttgcacaccacattgccgtctgggatgtgatcgcctcttgtgatatcgaaggctccagtgatagcagtatccacaatgtcgttcccaatgacctttcagagattcttcagacggcatccatccagcagattttcaccaacggtggcactgcataccgcttatataaaaaatactgttttccacaaactcagcaaaaagcaatctgtctgccatccacaagtccggcaaatgcagcctggtcaaagaaacgcctgcttaccaaatggaatcagatctgtccttatctcgaataagaaccagcaaaccggctttaatcgccccgttcaaaaatgaggttaagattttttgaacttttttcattttaatacttgacatattattttttctgatgtatacttgattttgttgttgagcaacacagttcaacacacgatataaatgtgcgtttagctcagctggatagagcgtttggctacggaccaaaaggtcgggggttcgaatcctctaacgcacgctgtaagaggtctttcgtgagaaagacctcttttttatatttgccaagctgggcacatataaaaagtgcccagataattttcataccaggacacattcatttcatttcatttcttttcgcttttccactctgcattctatccaagtgccacatccagcgtcgttccaataaaagggatcatgatcccggtaaataaattcatgctttaaactgctgctcctgcttcctgtgttaaaatttctgtcagagccgcaccactgcttgtatggctgcgaaccaccttcgcgttgcttctttttgcctcatcaagcgcggtttttaccatcttgtgcgatactgtatttgtaaaaagtacaaacaggtcaggctgtccaagctgcttattcagatcggcagacatatgcgtaaatacttttgctttacatttaaactgtttgcatatttttttatactgacagaccattctgtcatgacctcctacaattacaacgctcattcttatccatctccttaattcattctaataacaattgtgattttttgtatgccgccccgtagaaacggagcggctcttttttgatgattatttagcttttaatttttgatttttatttgtttttgattcgattataattttatttgattatttagctttttcggttttctgttttatttaaaaggtattcgtatttcttataagccagccacctccctgccgagtgactcacactcatctattgcatctgctcccggtgttccgtggcagataagtccttctccgccgacgatctgtgcgccagcctgttccattctttcagcccatgtacgcatccattcaccgtcgccccagtcataggatccaaacagggcaaccttttttcctgatgcaaatccttccagttcagatacaaacggttctaccgttccgtcttccagttcttcagctcccattgcagggcatccaagtacccagacagcctgatcttttaaatcagcaggcgaaatagtttccatcggtactacatcagcacttttccctgctgctgtaattcctgctccaattgcctgtgccattgcttctgtatttcctgttccgctccagtatgctacacaaatatcactcatttttaaattcttcctttcttttttctttctatcatctaccaggttttattcctttatgcaggctgtatgtcaaatggctgtctcacgcttcttgctgcatgccacagatccttccctgcttgcatttccctgataaattcctcttttacaacgttgtagatagaaaacattttcttgcgttcttctacgttctcatacactttccagtatccctgataaaggaaatcttttccgttgtgctcaataaaccctttcacatctgcaagtggatatccgaggaaaattccaagttcatgtggaaattctgcacttccatgctgatatccttcaaatctcagattcatgatctgaagcatctgcggaaactcaaatccccgatagccaagtgtatcaagaaattcgctgtattctttttttccaaggatttcaagaatctcttcttctctgtagatcagccatacttttcggactccgctgtcgcaaagcatgctgtatgaaattcccatctctttcagactttccgcaacttccttttcacttacatttttcaaggtcagaatattggatggctttacaccggtcaataccggagcacactgccatgcaatttccatctgagcagatgtctgtacatctttctgcatccagttcatgttgttttcctcttgtatgagtttgtttaaatttattttggttagctatttctaactatttatagtctactatattagtgggattttgtctataggaatttttgagaagttttctcattaacccgtaatttgtgtttttacaacatacattctatctgccctggaaatatatcttactgtaattttgtaatcatttctgcaaaaaaaagtgtatcaaagtttttcaaccttgatacactgtatttttacaattaacagtcttccgcaatcttatcaatcagtctcactgtatcttcccatccaatacacggatccgtaatcgatttaccatataccatatttccgccgatatcctgtcttccttctaccaagtagctttctaccattacacctttaatcagttttttcagctttgaatcataatttcttgtgtgcagtacctcgcttacgattctgagctgttctttatactgcttgttagaattggaatgattggcatcaatgatcgctgcaggattcttcaaattcttctgctcatacatatccagaagtctcttgcaatcctcataatggtagtttggaatcgttgtaccatatttatccacgccgccccgcaggatcacatgtgccagatcattcccacctgtcgtcacatcttgcccacgataaatgaaacggtgcggtccctgtgctgcaacaacagaattgagcattaccgataaatctccacttgtcggattcttcatcccaatcgggatatccattccgctcgcagtcaaacggtgctgctggttctcaaccgaacgcgcaccaatcgcttcataagaaagaatatcatccagataacttctgttctctggataaagcatctcatctgctgctgtcagataagtctcctgcatggctctgatatgcattttacggattgcaatgattccggcaagcagatccggtgcctgctccggatccggctgatgcagcattcccttgtatccctctccggttgtacgtggcttgttcgtgtagattcttggaatgatcatcagcttatccgatactctgtcatttaactttgcaagcctgttcacgtactcacataccgaatcttcattgtccgccgaacatggtccgatgatcaccacgaatttgtctgatttccctgtaaaaatatcacggatctcctcatcccgcttcgccttgatagcttttaatttatccgataacggatattcgtttttcaggtctgccggtaatggcagctctgcgttcactctcattcccattgtattatcctcctgcatgtatttttctagtcctgataatatcttaccatatctcttgtaatttctgaaacagaatgtgcaccgcacatctgcatggcatctttgagttctgctcccagcttatcaatgtaaagcttcacaccttcttctccaccgccatagaccgctacaacgaacggccggcagatcagtacaccgtcagcaccaagtgcaagtgccttgaaaatgtctgtaccggagcgaatccctccgtcaaccagaatcttcatagaaccgttcacttcttttacaatctcttccagcacttctgcagttgccggacactgatccagcactcttcctccgtgattagatacgatgatcgcatcggcacctgcttcttttgcttttctcgcgcctttcgctgtcatcacgcctttgacgataaatggtcttccagccatcttcacaatctcggaaagctcctgtacattcttgcttcctgccggcggattcatatttttcagaaacggaagtcctgccgcatcaatatccatcgctactgcaaatgctcctgacttcttcaccagttccatcttctcccggacagtatccagattccaaggctttactgtaggtatcccgcatccatcattttcacggattgcctccgttgcagcctccattacctttgcattcactccatctccggtaaatgcggcaattccggcatctgcacaggctgataccagtacattattataagaaacatcatcatacctgtcactgtagtgcagattcacggctccaaccggtcctgcaaagaacggcatcttaaattcctttccaaataaattcacagaagtgtctgcctctccgccatcacaaatcgtatccatgttcacgcggatctcctgccactttttataatttctgatcgcagtatcaccaacaccttttgcgcccggtcccggtatctggtttttacatgctcttccatcacaaaccggacaggctttgcagtaaagccccatagataattttgcgttttccatcatttcctgatatgtcatatcattccctgctttcttttgttttcctgtatctgacagctccgactttctgccacgttacttagtcagtatgatatcacttttctgtctgttcgacaagaatacctccttgtttttgacaggattttcccctataataaaaacagaacacttgaatcataaaggagacttaacttagaatgaaatgccctgtatgcggtcacaaagtccgccccagcaaaaaatatcccggcaaatatctctgtgatacctgccgtaaaagatttccggcatccgctgtgattccggatgatacagatacccgaagtgccagatcttctgctcataagcatgaatctgtttccgtaaaaaagcgcccggctgccagacagcaggcttttttcgacgatcccctgaacggaccggagatctaccacagcacagctgctgccatgcgcagcatgcgtaaaaatgttccggaagcagaagaagcagaagctcagaagaaaaccattgaaaaaaaagagactgaaaaagtttctacagacaaacccttttccggaaatgaatcctccgtacaggagcatgctccagttccagaaccagttatcagctccggtcaggcagatgaacctgctgccaaaccaacgccagtttccaaaaacgatactgcaggcacaaagtccgatgcatcttctgatgatgtaacttcaccagaccagctaacaccccccaaaaagaaacacaaaaaaagtctgccgtttatcatcctgattctcatcctgatcattattgcggttatattctttttttccaaaatgcacacttcttctgacaattcttccggcacttcaacaccgaagaagacagctgatgccaccaaagagatctataagcaaaatgagaccgccgcatacaatggcattgagatcacgatggacagctacgtagaatccgaaggagatgactggtctgtcccgacagaaggcaatgaatttatgtttgtccatatgacaattgtcaatcagacatctgatgatctggtcatcagcagtatggcaagctttgaaaattattgtgacgataccaaacttgactacagtgcagctgcatttactgctcttgcaaccacaagcgaccagccaaagctcgatggaacgatcgctcccggcgaaaccctggaaggatatctttctctggaagtcccactgaactggtctaccatcgaaatccgatataccgataagatctggtctgatgatgccgttcattttcagatcaagcgccaggagtaaactactacctgcagatacatggatggcaaaagcaagcttcttcggaattctctgtcaaataaaaaaggatgcagctctaagactgtatccttttttatttcagaatcttaaagattcactccgcgcattttttctttcttactgcccctgcgatcacaatcagaacgccaagacctgtcagtatctttcctgctgtcactccaggcgcatgatacaaaattctgattttatgttttcctgcttccagatgaaatcccagaaacgctttattcactttttcacatttcacctttacgccatctatcgtcatttcaaaccctttatcaaacggaatggacgtaatgaacattccatccttctgacttttgattctcccctggatcagattccctttcgtctgctctttatccaccctgaatacactctgataaaggccggtatcttcatttaatacgccgttatatgcactcatatctttaatcgtatactctccttttccaagagataaacggaccgttttctgccccttttccagtcctactgcataggtaaatacggtatttctgttataatacacatgctggattgacgaaagtttattgcgctctccttccagggatatttcgatatcctctttcggttttttattttcgattcgaaactgtacaaacagaactccatttttctcttcctgttccgggacagccacttcgaactcctgtttctttttcattttcacctgatatccgttttcagtcgggacaaccagtgaaatcccgttattcttttccggaatccgaaaatcacatttctctatgtcttctgctagtttttctttcacctgtcctgccgatacagttccgtcctttgtcacagcatatctggtaaataccagctgattatatgggaaatccagtctgtcatattccgcttccgacatcgtctgatccgtctcataggcaatcggtgctgcattttcattacagtacacatcccctcccccggtcatccactttttctcatatcccggtatattctgactggagatcagatatttcactcccatcagctgtctgaataccggattctgcgaaaccgactgcatcagaaaatttcggtacggctgctctacctgaaaatcatttttacggaaattctggtaatcagcattataggaagacgaatacagggatgtaatatattgctcactgttccacacacgattcagattttccgcattttcctcttcatttccaacctgctcgacccggtagaatccactatctgatgtaattgccttgtccacagctttcccgatggaccggctggtatcttcctcatatgctttcctgctctccagatttccactcttttcccaggaatagcttccggtaacaagaaggcacaggatcaccggtcccagaaccgcaactgccagatacttccgaatccatgcactgtatgcctgtgccatgcagatcagcagcgtcatgaccgcatccagcaacaagagtttccacagaatctcacttttcacatcatccttcttcagataaatgtaaatcacaaccatcagacacggcagaagcatccagattcgcgctatcttctgatttttcagtttctccagatattttgccgtaagatagcaaagaagcggtaaaaacgggatcagcgacttcggccggatataaagggctccatttaacaaataggagaaaaatggaacggtaagcaccaccagacagccaagcgacagaattttctcataggctttcttataaaaaagtccggtaagcaaaatgatcagtaccagacagctaagtcctggtccatatgccccgtacagaaacttcttcaaattgatctgtggtatcaggagctgcagaaaatttaccttttctcccctgctcctgcttctcccaagaagtgccatagccgtcggcacaagcaggactcccgcaagcatgattgccgtcaggatccttcctgcgaactggattccatctcccataaatccttttaccgtaaccgtctcttctgcccgttccttcgtccttgcataccggtaaatcccgtataacccaagcgccaggattccaccaatgctgaaataaaaactggtcatgatcatcagaaatgttccaccgatcagcaatccggattgctttttttcaaaataccggtcaattccaaggaaggtcaggcagagaaacggcatataattaacaaacatgatctgatgcgaggactgatagatcatcggtcctgcaaaaagaaacatcagcgccgtcatcccgctgactgctacagtaaattcccggcttctcagccaccggtacaggatcataaccgcggctgccagacagactatgctcaccgtcatcatgtaatccgacatctttacatttggcagaagataaccgatcagaacaaccggactgaacaatccataataagaaaaattgtaaatattttgcccgccgccaatatttaacgcaaattcaggaaagagcttcccggtccggtaaaactgctgccggaaatattctggaaatacactgtgctggctgctccagtccaccttcgccccgaaaatgtttcccgcgcctgtagagtacaggcatgccacaaccgtgagtaggacaagcgccacttcccataacaggtcttttctacattctttcatgcttctgctccttctcgtcgctggaatcctttaaaataaaaatcggtcgtttctttgtctccagataggttttcgacagatactctccgacaattccggtgcagagaagctgtacaccactgaccatgaaaataatgcaggcaagggacggccatccggataccggatccccccagaccagcgtccgcacaataataactgcaatcatgataaatgacagtacgcagaataagacacccactaccgaagccagcgaaagcggtgcaactgaaaaacccgtgattccttccaccgaatatttaaacagtttccacaaagaccacttggtcgttcctgccgagcgctcgatgttgtcatactccagccattttgtccgaaaaccaacccatccgaagattcctttggaaaaacggttgtactcgctcatttccagaaccgcctgaaccattttccgcttcatcagacgataatctcttgctccgtccacaatctctgtttttgaaatcgcattgacaaatttataaaaactttcagataagaaagaccgtatgcgcggctccccggttctggtcgctcttttggttgccacattgtcatatccatcctcctgcaggatctcatacatctcaggtaatagcgccggtggatcctgaagatctacatccataagtgcaacataatcgccttccgatgctttcagccctgcatagattgcagcttctttcccgaaatttctggaaaatgacagatatctgcatctgctgtccttctcattcaaatctttcataatgccaagtgttgcatccgatgaaccatcatctacaaagatcagttcaaatacaacttctttcatcttctccatcacgcggcacatttctttataataaacaggcagtgcttcctcttcgttataacatggtacgactaccgaaattttatccatattcttcacctcgggagtagagtttacactccctttattaagtatgcacattcattttccttaatatttcctgaaaaatttctaaatagaaaattacattaaaaaaaagaatgtgctccggcactttccagtcccagagcacacacattttccatacctttattcaacaattgtatactgaagtaattcataatgaaggcggcttccttcccggatctcttccggaagaagtgctcttgctaccatctttgcctcttcctccggcagatcggtccgcttcagcatcgcatagtctccgtcgattctctctacaatataatcacaaaccagcatcttgttcctcctcttttttcttctatcttagctcgccgccgctcttttttcaactacaagctcaggagttacattctgatgccggtaaatactcagcaaaattcccatcaatactgctgaaaccatctgaccgcttcgtccatatccaaagaacagacaccaggcacactgaccgatcccggatatcccaatgttcgccagcagtgataacagaaactggattgtcagaaccatcacgcatccaaatcccatcatcatgccaagctggttcttctgcttcagcgtacttcttaaaaaccagcataacagaccggcaatcactgcaatacaaagtaccatcacaaggattccaaagtaccctgcaattccaagcatcatatagtcagcagaactgatgcggtctccagcccaaaagcgatcgactccggaagcacgtccaactgccatacatctcgacagcagttcccgtactgccccaatcgtcgtgtctttcatccttcctgcctctttatccagcacaaacatcgcccggatacgcattttctgatattccgcaccaaagaagaaaaagtatgctaatatccccgccggaattccgactgtcagtatcccgagcccggccatcacttttctgaccgcaacctgataccatcccttttccaacgccagcatcagcataaaaatgcaggaaagtcccaccgttcctgccatcacagaatccggacaggtaatcaggaatcctactatcggcaacatccagactacagctttcaacacggcaccgtaaccttctccccggtaccggtacagcactgctccatataatggaagaaacaaccagctcatcagtgaaagacttacgatgaagccaccgactccaatccaccttgccgcaccattgatctgaagaacaaaaaaatgtctcatcagaaccataagcagaagataaccaccggcaaaaagccttgcatgctttccaatccagctgtaatccatataacacaccagaatcataaccggaaatgccatcgctatccggaatatctgccggatccctgcaacatatccatagctttcactttgtttcaaaaagaatgctgcaaaaattccactcaggatctccatcagagcgatcaccagaattgctttccacggcatcttcggtctgtggatctgatccatctccacaccaacttcaaccgggtcgcccatctcacgtactgcagctttttctgcctccgcctctgtcattccttcttcgagaaatgcctgtttctggtcttcaatatgatcttctacttcacgtgcgatcaccggacacatctttttacaacggatctgacttgtcagctgttccagataatcacgtcgttccaaagcacacacctccgatcacctgtaaaatagcctctgaatactctttccattcttccttttttactttatactgctttttcccttcttttgtaagctggtaatacttcctcatcttgcctccggcttcctgctcatatacggtaagccatcctttctcttccatggaatgcagaagcggatataaggttcccgctttcagttcaaatacattgttcgactttcctttcagagtgtcgatcatctcatatccatacatatccttctcttccaacaaacttaagatcaaaagcgtcgtactccctgatatcaggcttttatcaactgccatctcgttctcctttcttatatcggtcatctatatattatctgtttgtcattatatatcggcaatctatatatgtcaatactttcactggaatttatctcttcttcataagtttttaagatatttcaggatttctttatccgcccgtcacattctttccataatttcccgttatactaaatgcataaagttaagggacgccgataatcctatacgatatcagctctgtaaggttatcaggatgtccgcctaaaaaatcaggcatacgtctttgacttataccttttatatatatcttctctctactctgccgatacagttttgtatcggctcttttttcatcttatgaattttcagctttccgacacagatattcctcattttctccttaagctaaaaatttagccgaaaaattttatttttttcaaaaaaacacttgtcaaaatcatatagttatgctattataattttcggtcactgttataaaacagttcaccaaaatagttttggctccgtggtcaagcggttaagacatcgccctttcacggcggtaacacgggttcgattcccgtcggagtcacttggtttaagccaattgtatatacacagcaatatgccgatgtggctcaattggcagagcagctgatttgtaatcagcaggttatcggttcgagtccgatcatcggcttttgtccttagtgggacgtatttaatttggacctttagctcagctggttagagcaatcggctcataaccgatcggtcccgggttcgagtccctgaaggtccacttttttaacaatttcatatggcccgatggctcagttggttagagcgccgccctgtcacggcggaggtcgtgggttcgagtcccattcgggtcgcttaactgattattcagttttcgggatcatagctcagctgggagagcatctgccttacaagcagagggtcataggttcgagccctattggtcccattttcattataatttcataatgatatgccgcagtggcggaactggcagacgcccgggacttaaaatcccgtgggtagtgatacccgtaccggttcgattccggtcctactccgcaggaattattgtgtgccatcatacctgcccacataatgtttgctcttgcctgataattatccgggtctgcaatgactctcggtccttcatggatcatcgtcagaagaagcccttcgatcatacggtctgtcacttctacttcttcggtattggtcagataacgctcatacagatgtgccataatatctgtaattccgcaagctgtctgatatgccggaagtgtctgcgtaagtgccgggttcatgatcgtgaatttcggacggaatgcttctccggttgcccctcttttgaacattccttcttcttttgtaataacagagtccgatgatccttcacttcctgcagctgaaatcgtaataactgttccgatcggaagtgcttcctcgacaagctttccttcataataatcccaaaaatctccatcgtatactgcacctgccgcaattgcctttgcggaatcaattgtacttccgcctccgactgccagtacaaaatctactttttctttccggcacagatcgattccttcatatacaagaccacttctcggatttggctttacgccgcctaattctacataagaaaccccttctctgtccagagatttcttaacacgatccaaaagtccggaacgaatgacagaacctccgccataatggagcagtacacgactgccgccaaaacgttttacatactttccggtatcattttctgtatccttaccaaaagcaaaataagtcggtgcataaaatgtgaaattttccatcttttatttccttctttcctcttatgattttctgctaatttttagtataaatccttttttgagacttcgcaagatgacgtagaaaatattatgttctccctgttcttcagataaattttcgtaatacatccaagccaaaatcagtatttttcttatccatagccgtattttctcttagttgtccgccagtgcaaactctgcaaatttctccatctcttttgtcttgaacttatttttatgatagaaaatctgacgatacatcgtaatttctatatctttcacatccaaaagtgtgagtttctttttctcaatatcatcttctactgcaaaacgtggcaggaatgaaacgcctcccccacgcatcagcatttttttgataaatgcagtatcactgatctccagcatcggagaaagctcttttcttcttaacgccagctgaccatcaagtgcctgcctgtaattggcattgcgctctgtaagataaaaagactctttcagcagatcatcaagcaataaatttctttcttttgccagccggtgactgactgatgtcacaaacataaccggttctgccttctccatcaccttgatccagttgctgtcccatcttggtgtatccagaatatagatcagatccagttcattatgttccatcatctggatcaacttttccggagaatctaccgtgatccggatagaaaccctgggatactgttccctgaatttccttatgatctttggaaatttcaccgtacacagagactcgatcgtcccaatgtgaagtggatttttcaattcatccgtatcattcatggatgctttcgcctgatgaacatcataaaggatccggttggcatgctccagaaattcttccccctgcggggtaagcaccactttctttcctgtcctgtcgaacagccttttcccaagttcgttttccagctggcggatctgaaccgtcactgccgactgcgaataccccagcatctctgccgttctggaaaagctctgcatctgcgcgatctgtgtaaaagtctgtaattgacgtaattccatcttctgactccattatgaaaaattttcaacgtcttcataaaatctatgaatttgtttcactcataagttgatggtacaatataactaataagacgtcaatcctttttacttacgtaaaacaattattttacaggaggtttactatgtcctttatcagtgtttttgatgtcatgggaccgaatatgatcggaccatcaagctcccatactgcaggagctgccagaatcgctctgcttgcaagaaagcttctcaccggttctcttaaaaaagtagaatttaccctttatggatcttttgccaaaacctatcatggtcatggtacggaccgtgctcttctcggcggtattatgggatttgccaccgatgacgtgcgcatccgcgattccttccagattgcgacagacaacggaatcgaatattctttcattccgaacaacgtagaaaccgacgtacacccgaataccgtcgatatcctgatggtaaatgaagaagggcaggaaatgacgatccgcggagaatctctcggtggcggaaaagcccgcctgtgccggatcaatggtgtggaggttgattttaccggagaatacagctcgatcgtcgtcgtccagaaagatgcaccgggcgttgttgcttacattaccaaatgcctcagtgagcttggaatcaatatcgcattcatgcgtctgttccgcgaatccaaaggaaataccgcttataccatcgtagaatccgatgatctggtaccggaagatatcgcagatacaatcagaaaaaacaaaaatgtatacaacgttatggttgttcagatgtaattggaaggagaatacagattatggattttagaaatgcaaaagaattattaaaagtctgtcaggaacaaggcctttcaatttctgctgtgatgcttcagagagagctcacagagggagaacaggatccgaaagagacagaccgcaaaatggatcgtgttcttgagatcatgaaatcagccgcttctactccgatccataccccggtcaaatccatgggtggactgatcggtggcgaagcaaaaaagatctcagatcacaaagataccggaaaaggtctttgcggagatcttctggaaagagctgtcatttacgcgatggcaactctggaaaccaatgcttccatgggtgtgatcgtagcttccccgactgccggatctgccggtatcgttccgggacttctgcttgccctccaggaaacctatgatctttccgatgaacagatcaagcagggactttataatgccagcgcgatcggttatcttgctatgcgcaatgcaactgtcgccggagcagtcggtggatgtcaggcagaagtcggaatcgcatctgcaatggcggcatctgcaaccgttgaactgatgggcggatccccggaacaatcccttgccgcagcatctactgttcttatgaatatgctcggtctggtctgcgatccggtcggcgggctggtcgaatatccttgccagaaccgtaatgctgccggtgtggcaaatgcaacgatcgctgcagagatcgccctttccggagtacgccagctgattccattcgatgaaatgctggaagcggtgtacactgtaggaaagcgtcttccggcagagcttcgggagacagctctcggcggatgcgcaacgacaccgtctgcatgcgcagcctgccatatgtgtgactaagctgtgtaatgttttgcaaatatagaccagcacacactgcttacaattttacgatataaaaagcttctttttcagaaacggccctcctgtttttctgaaaagaagcttttttgtttacttattttgattttctcacttactattatgacatctcataataatgcgcataaattccaccctgctcaagcaattcatcatgatttccccgttcagcgattccattatttgcaaccacaagaatctcatccgcattgcggatcgtagaaagtcggtgtgcgatcgtgatcgtggtccggttcttcgcaagctcttccaggctctgctggatccagcgctcactctcattgtcaagcgcactggtcgcctcgtccaaaatcaatatcggcgggttcttaagaaatactcttgcaatcgaaatcctctgcttctgtccacccgacagacgggttcctcgttctcctacaaagctgtcatatccatccggcagggacatgataaattcatggatatttgccttcttcgccgcatcgataatttcttccatcgatgcccccggttttccataagcaatattttccctgatcgatccacagaacagatagacatcctgctgtaccagtccgatctggcttctcagactttccagtgtcagctttcttacatcctgcccgtcgatcgtgatcacacctccggtcacatcataaaatcttggaagcagggaacagatcgtcgtctttccacttcccgacggtcccacaagggcaatggatctgccagccgggatcttaaaagatacccgatccagtaccggcgtatcatcatcgctgtaatggaaagaaacatttttatattccacttcaccctttacattttcaagtggctccgcatccggtgcatttacaatctccggctccgtctccacaacatccagaaagcgccggaaaccggaaagacctttctgcatcatctcggtaagctccacaagaatctggatcggactgataaaaattccgatgtaaagcgcatacatggcaagatcggcagcttccattttcccatgtgcgatcagccatccgccgaacactaatgtgatcagatacatcattccctggaagaaaagattgccactcataaagcttcccatacaatgatagtttgcatccttggataccagaaatccttcattgcttttctcgaatttctcccgttcaatcttttcatttgcaaaagactgcaccacacggattcccgcaagtgtatcctgcagactggaattgacatccccgatctttctccggttgtccataaaagtctcctgcatctgacggttctgcttataagaaaagatcagcataaatacaaccatcacaagcagcggaatcgccagtctccagttaataagaaacaaaaatgtaaacgaaccaacgattttaattacagatataaataaattctccggtccatggtgcgcaaactcggaaatatcaaacagatccgacaccagcttactcatcatctgtccggaattattctggtcataataagaaaaagaaagtctctcataatgatcaaataacttctggcgcatatcccgttccatatgtgcccccatcatatggccctgataactgacataatatttacaaaatgtctgtatgatatacatcacaagcaaagccagtccgatcggcagaagtgctccaaggatctgtgacggatcctctgtaaataaagtctttgtcagtgttcttaaaatctgtggaaatgcaagatccaccagactgatgatcgccgcacaaatcagatccagaaagaatactgtcctgtacggcacataatattttacaaattttttcagtgtatgcatcactttcttttgtgcaatgtccggattccccgttttatcacactttacctccttgtccccaaaatcatatattattatatcgggaatctttcgttatttccaccttattctcaaattactttgagaattttccttccttcatctttttattctgctgtttttatgctatgataggacagattgttatgagagtaacttatttatttcacttgaaaggggtatttctatgaattttataacaaaaagctggaaaggcatcttactttgtctggtcatcgccgttccatgctggtttctcggacagacatttccaatcatcggcggaccggtattcggtatccttgccggaatgatcattactttattattaaaagacaaatccatgtttcaggacggtattacttttgtatcaaagaaggttcttcagtacgctgtaatccttctcggtttcggactgaatctctccgtgattctggaaactggaaaacagtcactgccaattatcgtaacgacgatttcaacgtccctgatcattgcatatctgttacataaagttatgcatgtaccgggaaatatttccacactggtcggtgtcggatcttccatctgcggaggctctgcaattgccgcaacagcaccggtcattgatgcggatgatgaagaagttgcacaggcaatctctgttatcttctttttcaacatgctcgccgcactgttcttcccatcacttggtgcactgcttggattctcaaccaaaagcggggaagccttcggtatctttgccggaactgcgatcaacgatacctcttccgtaactgcagcggcttccacctgggattcgctctacactctcggttctgccacactggataaggcagttacggtcaaacttaccagaacgctcgcaatcatcccgatcacactggttctcgcatttatccggacacgcaactccaaagccgaaggaaagaaagtggaatttaaaaagattttcccgatgttcatcctctactttgttctcgcttccgtgatcacaacgatcgcaacttcagccggcgtatccgcagatgtatttactcctctgaagacactcagcaagttcttcatcgtcctcgccatgagtgcagtcggtctgaatacgaatatcatcaagctgatcaaaaccggcggcaaaccactcgctcttggtttctgctgttggatcggtatcacgatcgccagtctttccatgcagcatgtgcttggaatctggtaaatgaaaatctttctcatacttcaaaagccttgcataaagcagggctttttctataatacagcttgccgatgccagcaagatgttcctcttattatccttatgtccagaaaagggaatgtccatgccataacactaaacattccctttcccatggttgatttttcattatctgtaattctccgattcccacattcgaaaactctctcagattttatttttcgattcaccactactatacagcttttctgatagatatttctccctttttccacatctcaaaatacagatcaaatcctaacttcattatactatccagactttctcaaatttccatttatatagatggcaaaaagggcaacatacaggattttgctcctgtatgctgccctcatcatatggtgtatttgaaagtttttaacgtgttgtcattatccttcgatactgatatatttcttctcttctactgccggttttacttctttcttcgggacaaagagtttcaggataccatgcttaaactcagccttgatatcttcttccgtgatatcttcacctacataataacttctctggcaggctcctgcataacgttcacgacggatgtacttaccagtttctttctcctgctcatcctgatccagtcctttggcagcgctgactgtcagatatccgtcattcagttctgctgtaacttcatctttcttgaatcccggaagatcgatctccagttcataaccatcttttttctctttgatatctgtcttcatcagattgcctgcatgatgtccatacagttttctctggatcttacgatctgctttatcatcataaaatggaaaatcaaagaaatcatcaaataagttatcattaaaaatactaggcattaacataagtcgttcctccttataaatctatctgaatttaactaactttctttttaagcggctgcctcatctggcagccttgtaaccggacgcttacaatccgcattctgattatccctcaatggaaatgtatttcttctgttctacagcaggttttgctgcttctttcggtacgaacagtttcaatgtaccgtcttcaaatttggctttgatgtcttcctgtttgacaccgtcgcctacataaaagctcctgctgcaggatccactgtaacgttcacgacggatgtacttgccatcttcagctttttcatcttttttcgtgttcgtctcagcactgactgtcagataaccatctttcagttctgcttttacatcttcttttttaactccaggcatgttcatcgttacttcatagcctttatcggtatcttttacatccgttgtcataagtccggattcactgtaatcatatcctccaaatggttctccaaagaaatcatccaataagttctctccaaaaatactaggcattaacataagtcatatctcctttcaaaagacatttattaatttatttagcacattcggatttactctgaagtgttgttgtcatctcaaacaccggtcggtggaatctttatcctctctttttgttccccttcctttgttctagctgtaatataacacttattattagcactgtcaagaggtgagtgctaatatttttgtgaagattttgtgaacgctacgagccatgcaaaatggtgaaaataaacgccctgcaagtttacttgcaaaggcgtctatttttgctattttatagggcgacagcccggcagcgagggaattctttcccgggctgtgcatggcgtatctcacagcttcacagggatttttcatttgctttcgcacggaggtttcttgatttgaccacattttacgacaaatctgcggatgatccgtttacagtaattactttttctgtatccatgctgcattatctctcttctgtattttttatataaatagtgcttcgtgccgcaccctcttttctcaaatagccgtccttaaccatattcagcaagacagctctggctctacgatgttttacatctgtcttaaaatctctactgtttcagcagtagtaataaagccattttccaatacatatttataaatttgttgttcctgttcactataaagacggatatctcttctgcaaaccggtccatatctcactgcttcatccatccgctcataataagccatcgaaaaatctacaattttataaatactgactgaactctaccttctccttattcggtccttcaatcgtaaagaaccgcacgccgttatcccagaacggaaggaaatgaatggtatccttcgttgtgttcattttttcagcttcaatataccgatacacttcttcgatatctttcacattgatcgctacatgatcaattgctccgctctccatctttgcagccttattttcataagtctcgatcacaagcgtttccagttccagaaatgcaaccttttcgtctgcttcttcattcaccgtctgaagtgcaatctcaaatcccagtttctgataaaaagcaattgttttttcaatatcatttgtcggaatcccgatatgctgaatccctgttgtatatgttttcagatccatcttaacgtcccatcctttcttcaacctgtgcaagttccggcattgcagggatcgcgcctttcctctctacacaaaggcttgccaccgcgttgccaaaccgtacatactctttcagttcatccatggtaaatgcttccggtctctttccggctttgctgatacagtataaaaatcctccccagaaggaatctcctgccccattggtgtccaccgctttgctcacaaatcccggaatatgtacaccgccttctttgcagtacagatatgctccatcgcttcccagcgtgactgcaatgatcttgacacccttccggaataaaatttctgtcgcttcttccggactttctttgtctgtcagaagcttcgtttcttcatctgaaattttcatgatatccacgtaaggaaccagacttctcatctgtttctttgcagtctcctcatccttccataaagaggctctgtaattcggatcatacgagataatacttcctttttcttttgcgcgccggatcgcataatgtgtggtatctcttgccggctgttccgtaagtgacagagaaccgacatggaaaatatgtgtcttatccagaatatcaacatcgatttcttctttttccattctggtatctgctcccggttttcttgcaaaagaaaatgttctctctccattctcatcaatatttacaaacgcaagagtcgtaaaatatttttcatccagaagcattccttccgtttccacgttttctttttccagcacagatttcaaaaactctccatgcatatcctttcctgccttcccgataaaagcggtatgtccaccaagttttgccaccgcaactgcaacatttgcaggagcgccacccggattctgggcaaatagtgtctgcccgtcttcatttactccctgccaggtaaaatcgatcaggatctcaccaaatgttgtaatgtcgtaaagcgaccgttttgccgcatcattggtatctgcaagaagtccttcttcaagcagtctcttcagaacctggttgcattcattttcttcgtccgtgtggatatgcagttctccgtattcaaattcaggcatacttaaaacaccgagcatggatttcgcattgaccacatatctgccactgcaaagctctacgtcacaggaaatccgctctgcaatgctgaccagtttccgtgcatttgtcatggttcccaatattactttcgcaatcattttttcctcctaagcaaatatgctgataatcagggcacagataagaccggtaaatccgataatcgtctccatcatcgtccatgattttaaagttgtcttttcatcaatttccagcaaggagcttaccagccagaaaccagaatcattcacatgactgaatgccgttgcaccaccggtaatcgcacagaccatcgctgcaaggtataatggcgaaagtcctgcaaccgccggcatggatgccataattccggctgccatcgtcatcgcaaccactgccgctccaaccgatgctcttaccagagctgcgatcagcagtcttgtcggatctgctgcaaatactgtttctgacattttcatttcctcccgtattcttcctgattagtgaacatatttgtggatcgttgcttttacagcacctggtcctgcgatcatttcacgaaacatttcttcaatcttttcaccgacaccatctttgtaaagatcggtaaagaacagacgttcattggacaggatcggtttcagctggtctttcaatgtctccggctttccaactacgatgtcaccaagctgttctccgatttcttcattcatcggatccggtgccagttcgaatttgtttccttcatcatcaactgccagcatatatctgagccagcctgcaataccaagcggaattgctgtcagttttgatgcatctccgtattttgccacataagcttttaccgtctcgccaaaacggataccaaccatctgtgacacatcaactgcaagacggagatttgtatctcccagatattcattcggaaaacggtcattaaaaagttcatccataaatgcctgtggagaaaggattccaggatctgccactaccggaagtccttcgtcataagcaaccattcttgccatcttcatcatatcttcatttgtattaagcatatgtgcgaacagatcatatccaagtacgacaccaagcggacctgtggctgaatgaaccggatttaagcataccgttactttcattcgttccgaaagatttactgtatttctgtccgccatataaactccaaatcctttttccagtgccgggcgtccgttcggaaaactgtcttcaatgaccaaatattgcggtttttctgcatttacaaatggagcaatgtaagtcttctttccggtgatgaccggctgcattttttccacaccgagagcttcaagatcatctgcaatctgttcgctcggacgtggagtgatcttgtcgatcatggtccatgggaaggcaacgactttttcatcacttacatatgtaatgaaatcatcatctacaaatccctgcttcttccactcttctgccattgtaagaacagattcacggagttttgcaccattcctggaacagttatccatagataccaatgcaattggatatcttcctgctttgaatctttcataaagcattgctaccagtactgccatggctcctgtcgctttgtccggtccgttcttaatgtccgcttccacgaatggaaaccaggttccgtctgctttctgcagagcatatcctttttcggtaattgtaaaggataccatctgaagagatttgcttgtaaagatctctttcaggcggttccactgtgccaaatcagaagactgtgcttttactgcttctgcaagggatccgagtactttatattcacgtgttccgtccccatgcagaattacgctcagtcccagattgtcatatggatcataaattttatctactacgtcatagtcaaatgtctctacacaggtgattcctctgtccagtacaccttcttccagaagtccgtctgcaattccaccgataaaaatacggaaaatattaccgattccaaaatgaacccatcccggttcttcttttgctttttcagatatcttctccacatcatatcccggaagtgcaattcctgccttctcccatgccgcacggtctttgattccttcgattgttaacttcattttgttacctcccgttttactttttctttttagttatgtttttgacttacgcttatatctaagttgtaagtgtagtatataaccacaaaagtgagttgtctattgacaaaaaatacaattttacaattctatttttatctatttttcacaaagtgaatcagaaagctcttgttttatccgcacatctatattagaataagttcatatcttgtgtgtatgattcacgcataagtaaaggagaatatcatgaaagaaaaaggaatgaccacgattaccctgaaaaaaatcaatcgggaaaaagtgtaccaatatatttatcagcaaaaagaaacatccaaactccagatcgttcaggatctgcagatgggactttctactgtcagccagaatttaaatgagctggaaaatgacggtctgatcagccggaatggatattttgaatcaaccggcggacgaaaggcccagattataaaaattgttgaagattttcgtatttcgatcggacttgggattttaaaagatatgtttcatattgtagccgtgaatttatatggagatgcagttgcaacagagacaattgagctgccatacgagagcagcgatgcttactactctgcccttgctgcaaatgtagaactgtttatccaaaagaatcattatgatcctgagaaaattgaagggatttcgattgccacccagggcgtcatctccccggacggaaatgttgttacttacggcgatatcatgggaaatgcaaacatgcagctgtctgatttttcttccagacttccgtatccatgtcatctggaacacgattcaaaagccgctgcagatctggaactctggaatcatccacaatttgacagtgccctgatttttcttctgaatcctaaccttggcggtgcgatcatcaccggacatgaagttcaccagggcgcagcagaaggttatattgtgtccagaccgcagagtggatattatgtgacggatattgccgagaagcaggaagagggcagaaagattgcaagccggcatgtaaggaagcaggagaatccggttgtctatgattttgcaacatcaaatgtagataaagagagtttccggtttgaattatggcggagatatatgaagagcgcaatgcgtcaggatgagagactgctttcttatggagaaccgcagggggaacaggagttcagggaagtactgtctgaatatattcagaagaccagaagtgtgatctgcagcccggatcagatcgtgatcggtgccggtatacagagtcttctgcatattctgtgcccactgaatcataaaaagagaaccgtatttttcagggacagtgagtttgtacagggaatgacggtttttgaagatcataactaccggattgcaggaagtgcggaagaagagattggaatgtattacgtgtcaccatcacagatgacaagatttggtggggtgatgccgatccaggaaagactggaactggtcggacgcgccgagaaagagcattttctgatcattgaagatgactataacagtgagttcaaatattttcagaaaccggttccgtccctgcagggactttcgggaggaagaaatgtcatttatctgggaacattttccaaaatgctgcttccgtctatcaggatcagttatatgatactgccgccggaactgatggaaacttacgaaaaaagaaaaaataattacaatcagactgcatccaaggccgagcagatcgcactgacacagtttatccgtgacggacatctggcgagtcaggtccgtaaatccaggaagatccatctggcaaaggcagaaaagcttgcggagagtatccacaaggtatttggggatacagtaaatgtaaagatcggggaagccggttttatggttcaaattatattttcaaatggaacagatgttaagaaagtggcaaaagcagcccgaaaagaaggtcttacattccgggaagccgaaggacatacgctgttactgacctgcgcaggtgtagagtcggacaaatacgaagaagctatgcagatccttgcaaaatgcgttataatagataatatgaagtgacctcacatttgtagcaatgtggatttacctgtatactagaatttgataagaacaaaggtaacaaggattaccgcatacaaaaggagatcactcatatgaaaagaatactaaaaattggcatgaatatccataccacaaattacacattatgcgcaatggaaccaataatcggtgaggctgacagtgtatttgaaacaatcaaggtaacatcggattataaaaatatcctgctgtttattgaaaatatgaaaatgaaacttgggttgaatgatgaatacgatattcagtgtggatatgaggcgggctgtcttggatattcactctataactagctaacagccgcaggagtaaaatgtgtgatacttgcaccaaaaaccatgcttacaccgcaaagtgtaagaataaagacagatatgtgggatgcatatatgatcacccaatgtttgtcatatggtggttatcatgctgtttatattccgacaggagaaagaaagggggaaaggatggaaggttcacatgaactggttctgccaaatgaggatctttcttttcgaatgtttttgtttgaagggaaagatggaaattatgtcagggaaaagcactggcaccggtcaatcgagatgtttgttgtgctggaaggtaaactggatttttatatcaatgaagaagacatccatctggataagaaaacctttgtgatcgttaattccaatgaactgcattcgatttcggcgtcacttccgaataagaccattgtacttcagatgccgcttcagacatttgaacggtattatacggatgagcagtttatctgttttacccacagggaaagagtacaggatgagcagctagtagaattggtggagaagatgtatgcgacatatcaggaaaaagagataggatatgagctgcaagtacagagttatttttacagattgctatatctgatggtgacgaagtatcggaagatgaatgtcagtggagaaattgtgcgtgaacataggaacaggaaccggctttcttctattaccggttacataaaagaaaatttcaaagaagatctttcacttgaaggagtggcgcagagtttcggttattcacccacgtatttgtctcggatgtttcggaaatatgcgaagatcaattataaagaatatgtacagggcattcgtctggaatatgcataccgggagcttaccggaagtgatgcattggtagaagagatcgcagagcataatggatttgcagatggaagggcatttgcaaaagcatttcagaaaaaatacggagtaagacccagtgagtttcgtcggagacagaaatcagaggatcagaaaatgagttagaaaaagttgacaaagacaagaaagtgcagttaacaggctaagtattcggtagcaggtactgaacacgcctgttaaaataaaaagaaagaaggaagaaacacaatgaaaatcaaaaatgtaacagatccagaattcagacgttatggacgtatcgttgatggctatgattttacagaaatgatcaaggtaatggagcagacaccacttccggaggaggttatttatgtgccatcggataacaaactggagaagacagaacctgcaattgatctgaagatgagaatttttggagaacttccaatacagatcggatattgtaatggtcataacagcaagctgaatgcgttggaatatcacagaagttcagaagtgaatgttgcagttacagatatcattttacttcttggatcagagcaggatattgcatctgattttacctatgagacatcaaaggtagaggcttttcttgttccggcaggaacaggaattgaaatttatggaacaacccttcactatgcaccatgtggagtggatggaaatggattcaaagcaatcgttgttcttccacagggaacaaacacagatctgatgacctgtcatacaaaatcttatgatgacaagcttctgacagcaaaaaacaaatggcttattgctcacgaagaagcaggtattgaaggtgcggtatgtggtcttaaaggagagaacatcgatcttgcaaaataagcggacgaaagtccttgtttaggaggaaaagatcatgaataacatgccagaagttaaaatcggagttgttgcggtaagccgtgactgtttcccggaaagcctttctgtatcaagaagagaagcacttatgaaggcttacaaagaaaaatacggagaaaaacacatttatgaatgtccgatctgtatcgtggaaagcgaaatccatatggtacaggctctggaagatattaagaaagccggatgtaatgcactggttgtatatcttggaaacttcggaccggagatctcagagacgcttcttgcaaaacacttcgatggaccaaagatgttcgttgcagcagcagaagagagcggcaataacctgattcagggacgtggagatgcatactgcggtatgttaaatgcaagctacaacttaaagcttcgtaatgtcaaagcatacattccggaatatccggttggaacagcagaagaatgtgcagatatgatccatgaatttgaaccgatcgcaagagcagtcatcggacttaacaatttgaaaattatcagctttggaccaagaccgctgaatttccttgcatgtaatgcaccgatcaaacaactttacaatatcggcgtagagattgaagaaaactcagaacttgacctgtttgaagcatttaacaaacatgccggagatgaaagaattccggcaattgtaaaagagatggaagaagaacttggagccggtaacaagaaaccggaaatcctttcaaaacttgctcagtatgaactgacacttaaagactgggtagaagaacacagaggataccgcaaatatgttgcaatcgccggaaaatgctggcctgcattccagacacagttcggatttgtaccatgctatgtcaacagccgtctgacagcacagggaattccggtatcctgcgaagtagatatctatggagcactcagcgaattcattggaacagttgtaagtgaagacactgtaacactccttgatattaacaactctgtaccggctgacctttatgaagaagacattaagggcaaattcgattacacactgaaagatacattcatgggattccactgtggaaatactgcatcatccaaactttcattctgcgaaatgaaataccagatgattatggcaagatctcttccgatcgaagtaacacagggaacacttgaaggagatatcaaacctggagatatcacattcttccgtctgcagagcacatcagacaatgtactgagagcttacattgcacacggtgaagtccttccggtagcaacacgttccttcggagcaatcggaatcttcgcaattccggaaatgggcagattctatcgtcatgtactgatcgaaaagaacttcccgcatcacggagccgtagcattcggacattacggaaaagcactttacgaagtattcaaatacatcggagtaccggtagacgaaatcggctacaaccagccaaaaggtgtacgttacccaacagaaaatccttggggttaattaaaactatacacaatcatataaggggcggctgaatgaacccgcccctttatagtacaaagaaacacgaattaaaaacaggatttatgtttcaagcaggcggttcaatgtcttgaggaccagattatagaaaataaatatggcagattccatttgaggcaatgaagatgagactcagaaattgtggaagccattgctgacacaatttccgctctaagaggctcatcggaatgctttgccgattggaaaatgccatatttattttctataatctggtcacaatccctcgaatccgtcaggttgatacaaaaaccctaacaaggaggtacatcatgctctatataggcgtagaccttggaacatccgcagtaaaacttctgttaatggatgaaaaaggcgacatcaaaaaaattgtttcaaaagaatacccattatacttcccacatccgggctggtcagaacagcatccggaagactggtttacccagtccgtagaaggcatcaaagaactgacttctgagtgtgataagagccaggtttcaggaatcagctttggtggacagatgcacggactggtcgttctggataaagacgaccaagtcatccgcccggcaattctctggaacgatggacgtaccacagaagagacggattatctgaataacgagatcggaaaagaaacgctttctaaatacacagcaaacattgcatttactggatttaccgcaccgaagatcctgtgggtaaagaaaaatgagccggagaattttgcaaagatcacaaaaatcatgcttccaaaagattatctggcatactgcctgtcaggaagcttctgctctgattattcggatgcatccggcatgcttctgatggatgtagaacacaaatgctggtccaaagaaatgatggacatctgcggcgtaacagaagaacagcttccgaagctttatgaaagctacgaagttgtgggaagtctgaagccagaagtagcagcagaactcggactttctgaaaatgtaaaaattattgcaggagcaggcgataatgcagctgcagctgtcggaacaggaacagttggtgacggaagatgtaacatttctcttggaacatccggaaccatctttatttccagtgcaaacttcggcgtggataagaacaatgctctgcattcttttgcacatgcagacggtcattatcatctgatgggatgcatgttaagtgctgcatcctgcaataaatggtgggcagaagagattcttcacacggatgatttcgcagcagagcagaaggatatcacaaagcttggtgagaaccatgtattctatctgccatacctgatgggagaaagatcaccgcacaatgacccttatgcaagagccacctttaccggtatgactatggataccacgagagcagatatgatgcaggcagtattggaaggagttgtatttgcacttcgtgattcccttgaagttgcaaaaagccttggaatcaagatcgaacgtaccaagatctgcggtggtggagcaaagagtcctctttggagaaaaatgatcgccaatatcatgaacctgaaagtggatatcatcgagagcgaagaaggaccggcacttggaggtgcaatccttgcagcagtcggatgcggcgaatacgaaagcgtagaagcagcagctgacaagctggttaagattgtagataccgtagaaccggaagcagagctggttgaaaaatacgaaaagagataccaggagttccgtcagatttatccggcactcaaaccggtatttccgcatattcagtaattgaatataagatttttatggcgtcagtcacattgaatcttcttctttgcagtccccgttgacagtgaaagttaaaacccgtataatgaattataagattgacatgatgtggagggcttgattctatgattattgcaaagaatgatgaagataaaagaagccgtgtgtggaactatgtgacaggaattacgaccgttctgatcattatcgtggctggatatttcatttaccagggatttttcggaaatccgctggaaggaaagtggaagcatgatgagagtgatatgatactggaagtagatgaccataatgaagcagagcttgactggaagaacctgatcgatggtaaggatgtggatgtggaacttggatatacactggatatcaaggcaaagcagattacatttactgtgaagcaggaagagctggatgagacagcgaaagaacttggtgataatgtaactgcatcggaagtagagcaggcgatcaattctgtactcactacattcaattacagtgtggacggaaccgagcttacacttaccgagtgggattatggggaccagatgatttttgaaaaagcagacaaataaagagaaccctctctctgtgggcacgaaagcccgcaggcagagggttttgtgtgagaacaggaggttaaaagcagatgacaaggaaggagacaaaagtaataaatatcggaggaagaaagatcggtggaggcaatccggtagcgatccagtccatgacaaatacaaagacagaggacgtggaatctacagttgcacagattcttgctctggaaaaggcaggatgcgaaattatccgctgtgcagttccgaatatggaagcagcacaggctttacaagagattaagaaacaaatccatattccactggttgcagatatacattttgattatcgtcttgcgatcgctgcaattgaaaacggtgcagataaaatccgtatcaatccggggaatatcggaagtgaggacagagtcagtgcggttgtggagaaagcaaaagaatacgagattccgatccgtgtcggggtgaacagtggttcgctggagaagaaccttctggaaaaatatggtggcgtgactgcagagggaatcgtggaaagtgcacttgacaaggtacacatgatcgagaacatgggctatgacaatctggtggtcagtattaagtcttcagatgtcatgatgtgtgtaaaagcgcatgagctgatcgcaaagaaatgcccgtatccgttgcatgtgggaatcaccgagtccgggacgctgctttcaggcaatattaaatcttcagtaggacttggaatcatcctttatcagggaatcggagatacgattcgtgtatcgctgacaggggatccagtagaagagatcaagagtgcaaaactgatcctgaaagcactgggacttagaaaaggaggaattgaagttgtatcctgcccgacctgtggacgtaccaagattgatctgatcggacttgccaataaagtagagacgatggttgctgaatatccacttgatatcaaggttgcagtgatgggatgcgtggtaaatggtcctggagaagcaagagaggctgatcttggaatcgcagggggaattggggaaggacttctgatcaaaaaaggagagatcatccgcaaggtaaaagaggatgaacttttagatgcacttcgtaatgaactggaacattggggcgaatagaagatgacaaagctattttttgatgtgtttccaacattgaatatcgataacgacagccatatgctgtttgaaaaggtggaggtgacgaaaatcacctccacttcagccagaaatcatatcaaggtttatatttacagtacccatctgatcccgaagaaaacggtatgttatgtggagaaccagattgaggaacagctgttttcgcaggaaaatattccggtgacgatcatcgaggaataccggctttccgagcagtatacgccggagaacctgatgcatgcctacaaagagagtattctttttgagctggagcagaaaagtgtgctggagaaaaatatgttccagaaggcaaagtgtcgcttcgaaggggagcgtactatgtgtctgactatggcggacacgattgttgcagagggaaagaccagcgagatcaccagctatctgaaggatgtctttgagaatcgtttccacgtgccggtggatgtagaaattgattatgaagaagtaggagagagcaaatacaagaaattcaatgaaatgcagcttcagcaggaagtagatgcgatcagggaaaggaatcagaagctgcaggcacagcatgccacggaagaggcggcaaaagcaaaagaaacggaaggcgtatcaaagaagaaagcggaaaaagcagaagatgccgctaaagaagcagatgcatcaagtacgcagaataaacaggaacagaagaaaccggagactccgaaaaagcaggaatttgcaggaaagtccagtgggttcaaaagtggcaagggaagctttgtgcgtcgggattatccgctcaagcgctccgatgacccgaacgtaatttatggacgggactttgacgatatgccgatcgagctgaagacagttaccggagagatgggtgagattactttccggggacaggtgatcagctttgatacccgtgagatccggaacgaaaagacaatcgtcatgtttgccgtgaccgactttaccgacacgatcatggtcaagatgtttacccgcaatgaccagctcccggatctgcttgcggagattaaaaaaggtgtatttctgaaaatcaaaggagttacgacgattgataaatttgatggagagctgaccattggttctgtaaccggaatccgcaaaacttcggatttccgtgtaacaagaaaagacaagtatccggaaaaacgcgtggagcttcactgccataccaagatgagcgatatggatggtgtttccgaggcaaaagatctggtaaagcgagcacatgactgggggcacccggcaattgcgatcaccgatcatggtgtggtgcaggggtttaccgatgccaatcatgtgatcgaggatctggataaggatgatccatttaaagttatttatggagtggaaggatatctggtagatgatctgactaagatcgcagagaacgaaaagggacaggacctggaaggcacttacgtggtattcgatatcgagacaaccggtttttccgctgtgactgaccggatcatcgagattggcgcggtaaaagtggaagacgggaagatcacagataagttcagtacctttgtcaatccgaaacgtccgatcccgttccgtatcacggaacttaccggcatcactgatgagatggtcatcggttcgccggatattgagacgatcttgccacagtttatagaatttattggcgatgcggttctggtggcgcataatgcttcttttgatgtgggatttatcgagcagaactgcaaaaggcagaagattgaggctgattttacttatgtagataccgttgcacttgcccgtgtccttcttccggcactgaaccgtttcaagctggataccgttgcaaaagctttaaatatttccctggagaatcatcaccgcgcagttgatgatgcaggctgcacggcagaaatctttgtgaaatttgtgcagatgctcaaagaacgggaactgacaacgcttgcaaaagttaatgaatttggggatctgaacccggattctattaaaaagcttccgacttatcatgtcattattcttgcaagaaatgacattggtcgtgtgaatttgtatcagcttgtttctgcatcccatctggtttactataaccgcagaccccgtatcccgaaaagtgtgctaaatgagcaccgggaaggtctgatcgtgggaagtgcctgcgaagccggagagctttaccgtgcacttctggatggaaagccggatgagacgatcgcgaagatcgtggatttttatgactatctggaaatccagccgcttggaaacaatgcatttatggtagagagtgacaaagtaacttcggtcaattctatggaagatatcatggatctgaaccggaaaatcgtgcatcttggggagcagttccacaaaccggtcgtgggaacctgtgacgtacatttcatggatccggaagatgaggtataccgccggatcatcatggcaggaaaaggatttggagatgccgataagcaggcaccactataccttcgtacaacggaggaaatgctggatgaatttgcctaccttggttcggaaaaagcgtatgaagttgtgatcaggaacaccaatctgattgcggatatgatcgagaagatttctccggtccgcccggataagtgtcctccggttattgagaattccgaccagatgctgcgagatatctgttataataaagcccattctatgtacggggatccccttccggagatcgtacatgaacgactggaaagagaactgaattccatcatttccaatggatttgcggttatgtatatcattgcgcagaagctagtatggaaatccaacgaggatggttacctggtaggatcccgtggttcggtaggatcttcattcgttgcaactatggcaggaatcacggaggtcaatcctctggttccacattactattgcagcaattgtcactatagtgattttgattcggaagaagtgaaaaaatatgtgggtggctgtggacacgatatgccggataagaactgtccggtctgtggacagaagctggtcaaagacggatttgatattccatttgagactttccttggattcaagggaaacaaagagccggatatcgacctgaatttctccggagattatcagagtaaagcgcataagtatacggaggttattttcggaaaaggtcagaccttccgtgccggaaccattgccgcacttgcagaaaagacggcttatggatatgtgaagaactattatgaggagcgtggtgaccgtaagcgaaactgcgagatcgatcgtatcgtagctggctgtaccggaatccgccgaagtaccggacagcatccggggggaatcgtagttcttccacatggagaggacattaactctttcactccaatccagcatccggcaaatgatatgacgaccgatattatcaccactcattttgattatcattccatcgaccacaaccttttgaaactggatattctcggacacgatgatccgaccatgatcaaaacgctggaagagctgatcaattccgatgcgatggacaataaatacgatggagtgaataatgtatttaaagcgactgatattccattggatgatccaggtgtaatgggactttttgcaggaacagaggtgctcggtatcacaccggaggacattgacggatgtccgcttggttgtctgggagtcccggagtttggtacagattttgttatccagatggtaattgataccaagccaaagacactttcggacttgatccgtatttcaggtctgtctcatggaacagatgtgtggctgaacaatgcacagaccctgattgaagaaggaaaggcaaccatttccacggcaatctgtacccgtgatgatatcatgacttatctgatcaacaaaggtgttgaaagtgaagaatccttcacaatcatggaacgtgtgcgtaaaggaaccgttgcaaaaggaaaatgtaaagagtggtcacagtttaaaaaagatatgctggagcatgacgtgccggaatggtatatctggtcctgtgagcggatcaaatacatgttcccgaaagcccatgctgcagcttatgtcatgatggcataccggattgcctactgcaagatcaattatccgcttgcctattatgcggcatacttcggaatccgtgcatctgcattctcttacgaactgatgggacagggaaaagaaaaacttctctaccatatgaaagaatataaaagaagagcagaactcaatcagctcagtaaaaaagatcaggataccttaaaagatatgaaaaatgtactggaaatgtatgccagaggatttgattttttaccgatcgatatctacaaatccaaagcatccaagttccagatcgtcggcgacaagctccttccaccgttcaacaccattgacggcatgggcgataaagccgccgaggctatggaaattgccgctaaagacggaccatacctctctaaagacgatttccgtcagagaacaaaagtcagcaagacattggttgacttgatggcagatatgggtttgctgggcgacctcccggagaccaatcagttatccctgtttgattttgcctaaataaaaagtcaaagtacttaaagataagttatcattcaatataacttaaaaaagtgctttggcttttttgcatataagagaaaagtataaatttgcatttggttaggttaaacaaagccttttgctgcattttgccagtaatgtagaagccagagttccgttccgactatatccatttccaattccgttgagtgcaatggagatgaaacacaagtcggaactctggcaccaccggttccacacccataaaaatgcatccatctcttccagcttccgtaccgtttccggattttccacataaaaggtcagttctacaagtcccttatcggctcccttacgaagcatatctgctgaatatcttccgcccagggcaagactgacactccccaggataattgattttccggcaccggtttccccggtcaggatattgagtccaccagagaaatccacttccgcctcatcgattagcgccagattttttacatgcaaattttgtaacattctttctcctgtctattgttccagtagtttcttgatcttttccatcagtagaatcgtatcatctacggtccgcacagcgcacatgatcgtatcatccccggcaatacagccaacgatctcattccagttcatcgcatccagtgccgcagccaccgccatcgccataccggataccgttttcagtaccagaatgttctgagccatatccatagagctgaatccatcccgcaaaatgcgcacatatttttcagtcattccgttctgtgcactctggagtaccgcatatttctgcctgccgttttctgccggaaccttggtgagctttaagtcgcggatgtctctggataccgttgcctgcgtcactttaaatcccgcttcattcagatactcggcaagctcatcctgtgtctcaatctgatatttgttgatcaattctacaattttggcatgtcggtttactttcatcttctagtttcctttcatcttttcacgtaatgtttccagaaagctcactttgctgagttttacgattttcgctgtctcccacgcctttttgatccgaatccggtcaccggtatgaagcgggacttcatccgcaccatcatatgcaatcactgcttcctcgatctgattttcccgttttgcaccaatctcgatcacgatctcatctttgtccgagaaaacgatactgcgggaattaagtgcatgcgagcagatcggtgtcacaacgatcaatgacgctgtcggctccacgatcggtcctcctgcagacagattgtacgcagtagaacccgttggtgtggacacgatcaatccgtccgcatcataggagttcagaaactctccgttaacatagagattaaaatgaacaatcttcatgctgccggatcttgtcatgacaatatcattaagtgccacatcccttacattgcggtatgcagcggatccatacagcatcattctctcttcaatcgtataattgccctctacgagctgttttacagcctcttctacattctgcacctctacctcggtcagatagccaagggtgcccatattgattccaagcatcggaagatcccgcccgaacagacgtctggatgcctggataaaggttccgtctccgcctaccgtcaacacacaatcaatatcctttggaatcttgatctttgaaaaatttccttcttccggctgctcttccagataacatttcttcccgtaggattcaatgcattttttgattttcacggtgatcttccgatttgcatccttcatatcattcgtgataatgtaaaacttttccatgtctttttatttcttctcctcagccggatccttttttgcaagtgtgtcaaaagcagcatcgacagtcccccgaatgtctacgctctccacaatccttgcctcttcctccggcctttttttcagatgtaccagatactcgatattcccttccggtcctttgatcggtgaaaattcaagtgctgctacttcaaagccgatcgatactgcataatcggttactttttcgatgacctcgatatgggtactcttttcccttaccacaccttttttcccaaccttctcacgtccggcttcaaactgtggcttgatcaacgcaacgatctctccgttctctttcaggtaattgcggattgggagaagtaccttcgtcagcgaaataaaagaaacatcaatcgatgaaaaatcaatcggttctcccagatcttccggctgtacataacggatgttggtcttttccatgcagaccactctttcatcctgacgtaatttccagtccagctgaccatgtcccacatcgatggcaaacaccttgactgctccattttgcagcatgcaatctgtaaatcctcctgtcgaagatcccacatcggtacatacctttccttccatggatacatcaaaattcttcatcgccttttccagcttaagtcctccgcggctgacatacggaagtgcatgtccacggacttcgatctgaacctcttccgaaaaggaagttcccgctttatcctctctctgcccgtccacgaatacattgccggacatgatgatcgcttttgccttttccctggaggatgccagatttctctttacaagtaatacatccaaccgttctttcattctctatcaatccctcctgctctcttctgctatatatgcagtgataatcctggccacgcaggattcaatatccagcatcacctcactgcgaagtaggtctacacttccgtgttcgatatagtcatccggcagtgccagattcagaacctctgcatctgtctcaagacctgccagataagcagtcacaaattctccgaatccgcctctgcggatattctcttccagtgtcacgatcagccggtgttccaccgtcagtttccggagcatctcctcatccaccggctttacaaaccgggcattgatcagggtacagttatatccaatctctttcaaacgcttccgaacctgaactgcctgctcaaacatatgtccgacactgatgatcgcaatatcttcttcttcatagaccggctcactctttccatactcgatcggtgctctgtattcacggaatccgtcaaatgcgctgcctcttggatagcgcactgctgccggtgctccaagtctcaccgcaaaccgcaccatgtccgccagttcccatttatttttcggagaaaggacggtcatattcggaatcattgacagataagaaagatcaaagatcccctgatgggtctccccgtcgcttcccacaagtcctgccctgtccacagcaaatacgaccggaagcttctgcagacagacatcatggatcatctggtcaaatcctctctgtaaaaacgaagaatatacagcaaataccggatgcagtcctgccgcagcaagtcctgccgcaaaggtcacgccatgtccctctgcgatccccacatcaaaaaagcggtccggatagtatctgtgaaatgctgccaggccggtaccgtcttccattgccgccgtgatcgctaccagtctgtcatctttttttgccagatccagcataaccttggaaaacacatctgtacaggaatcctttccacttttggaaatcggctctcctgtctggatatcaaacggacctgttccatggaaacgggaagggttttcttctgccgggagataccctttcccctttttcgtcaggacatggacaagcaccggtccttttaccctttttgcctcggtaaacgcacggcacagcgccttcaggtcatgcccgtccaccggtcctaaatacttgattcccatatcttcaaagaacattcccggaaccaaaagctgcttgatgctgctcttggtgcgcttaatatgccgcaccatcttttcaccgccaaacggaatactgccaagtacattttccacggtatccttcagatcggtataggcctgggcagtgcgcagctccccgagataactggacattccaccgacatttttggaaatagacatatggttatcgttgagtacgatgatgaaattcgtcttcatctccgcagcattattcagtgcttcataagccattcctccggtcagtgatccatcaccgataacagagatcacggaataatcctgtcccaggatatccctccctctggcatatccaagtccggccgaaatcgaagtggagctatgaccggtatcaaaggcatcacagtcactttctttcctcttcgggaaaccactcataccgccgtattttctcaaaccatcaaatccttctttccttccggtcagaatcttatgcgtataagactgatgccctacatcccagatcatcttatcctccggaagctgaaaactgagatgcattgccatggtaagctctaccacacccagattggacgcaagatgccctcctgtcttgctgatcttctcaacaagaaaagtacggatttcttctgcaagccttgccagttcccgttcatttaattttttgatatcattcgcttcgtgaatctgctccagatacacttcatccaccccgcttattttttcctgtgtatcagttcctgtatcagctgtgtcagatacgtattttctctgtccagcccggaaagcagctccagtgcttcctgtgaaataacttccacatctctggttgctttttccagaccttttaatgtaacataggttgttttttcattcttttcatcgctgtggaccggtttgccaagctcttctgtagtacttgtcacatccaggatgtcatcctggatctggaaagcaatccccacatccgatgcgatcttctgcactttctcaagctctgcatcctctgcacctgcaagaagtgccccgatcatcatcgaactttcaatcagcgctccggttttcagttcatagataaagttcagcatgccttcatcaagtcccacaccgcaggaagccacatccacgacctgaccgcctatcatcccgtaaataccggctttttctgcaaggatttttaaagcttttccaatcagaagactcttttcaggtgcgatttcaaatgcctttaccgccgtctcaaacgcatagttcagaagtgcatccccggcaagaattcccattgcttccccgtatacaatatgcgttgtctttcttcctctacggtactcgtcattgtccattgccggcagatcatcgtgcaccagggaataagtatggatcatctccattgctgccataaacggctcgatttcttttccttctcctccgaaaaggcggtatgtctcctgcatcagcattgggcggagtctctttccgcctgccattacactgtactccatcgcctccatgatctggctctgataaccttctgctttcggcatatattttacaagaagcttttcaatcacttctgttctttctttcatttcttctttaaaagtcatgtatttctccattctcttccagcacctgcacttttttctctactgtatcaatcttctcattacaaagcttcagcatttccatgcccttctgatacagtccgaaggactcttccagcgaagtatctcccgattccagctcttttgccacctgatccagctttgcaaaaagctcttccagagattcttccggcatttcttctgcaatctcgtttttcttatctgccattttcctactccttcttggtatctgttacctgtgcctcgatctgcccgtctgtcacataaatccgaagccagtctcctttttttacatccgctactttctttacggtcccttccgatccctgtacataggaaaagccctggttcagcttggcaagcggagaaagtcccttcatccgttcgatccggattgcaagctgctgacggctttcccgcagattccgctccatcagaagcggcagcatctcctgcactttccgagtcctctcctgttcctgttccaaccgctgatgcatggcttttgggatctgctcctcatagcccgcaagctgctggcgcatggacttaagtttccctgacggacttaagtaacggaatttttctgcataccgcgctgtatgaagtgatgcaatctccagctttctcctcatacttcggtgcatcctttcccgttctgtccggatcgtttccagaagttcccggtaattacagattgcaagctctgccgcagcagaaggcgtcggtgcacgaagatccgctacataatctatgatcgtcgtgtccgtctcatgtcctactgccgaaataaccggtacactgcattcaaaaactgcgcgcgctacattttcctcgttaaatgcccacagatcttcaatagatcccccgcctctgccaacgatcatcacatcaacctttgcttcctccagtgcacggattccccgtaccacactttcagacgcgccatccccctgtaccagtgccggatacagaagaatctgcacatatggatttctccgcctggtaatgttgataatatcgcgcactgccgctccggttggtgccgttacaacaccaactgtccgcacatattttggaatcggctttttatattccggcgcaaacattcccatttcttccagctcttttttgagctttataaatttttcataaagaagtcccgcaccatccagtacgatctcctttgcataaacctgatatctgccatctctttcatagacgctgacgcttccaagcacgattacctgctgcccttcctgcatacgaaaagaaagcccgctgcgctgcccggcaaacataacacaggcaatcgttccggactcatctttcagtgaaaagtacagatgtcctgaagtatggtacttacagtttgacacttcccctttgatataaattcgattcaacataaagtcttgcgtaaacatattcttaatgtacgcattgacctgttttacagtatatacatttcgcatgatttctgattcttatgcaagctttccgagtacaccgttgacaaatgccggtccctcatctcctgaaaaattctttgccagctcaactgcttcattgatcgctactttgaccggcacttcgtcatcccacttcatctcatatacggcaagacgaagaacagaaagatccactttattcatacgtccggttttccaaccggttgtatgttcattgatcatcgcatcgatttcttcttcatgtgctgcaatatctttgacctttttgcgcatatatccgcgttcttcctcactcgcttcttctacctgttccagatacagttcgatctgttcgtctgcatcagccgcatcaaatccgatgctgaagagcattttaaatatatgttctctgactttacttcttcgcatgttctctctccaattattcttcttccggcatgtccacacctgcaacacggatgtttacgtctgcaacggtaagacctgtcatattctcgattgctgcctttactttttcctgtacctttaaagtagtatctttgatactgctaccatatttgaggttcagggcaagggatacggtaacgataccttccagcacgtctacctttactcctttggaaaggctcttcattccaagctttgcgatcagttctctggttgcatttcctgccatggaagataccccctctacctccattgctgcaagtcctgcgataattgcaactacttcatcagcaatctgtacttctccgaggttctcatctgattctatcttataggtatttctctcttctttactcattataagtcctcctgtctgcggttcttccgctcctcgcgctcatctcggaacctttcggttcctcgatgttcgttgcactcacatagtcctggcttgaaaatgatccgtctgcaagcagccgatcatttcccacccaacactgcgctctttttacgctcctcgcgctcatctcggaacctttcggttcctcgatgttcgttgcactcacatagtcctggcttgaaaatgatccgtctgcaagcagccgatcattttccacccagtcctgcgctcgtcgctatgcgttcattgtaacataaaagatccttattggaaagttttttaggaacgtccgaattcggaaagtttcagtccttcgtttcgttccagcaccatacggatgctccagctgttgacaaacagaagaagcggtctgtctttcaggtccttgatcttcttcatatcggatgtgccgaccagcttgtccatattgatttcttcattctcgatccagcggatatgttcatatggaagtggttccagacggatctccacgttatattcattttccagacggtattttaatacatcaaactgcaagacaccgactacaccgacgatgatctcttccataccggtgttgaattcctggaaaatctggatcgcgccttcctgcgcgatctcgttgattcccttgatgaactgctttctcttcatcgtatccacctggcgtactctggcaaaatgttccggtgcgaaagtcggaattccttcgtatgcaaatttttccgctgaattggtcagtgtatctccaatagagaaaataccaggatcaaatacaccgatgatgtctccaccataagcagtatcgatcatgtggcgttcactcgccatcatctgctgtggctgtgacagacggactttcctgcctccctggatatggaagacatccatgcctgccttgaactcaccggaacagatacgcataaatgcgattctgtcccggtgtgccttattcatatttgcctggatcttaaacacaaatgcggagaaatcttcttctttcatcggatcgatcaatcctttgtcggacattctcggaagcggcgaagtcgtcattttaaggaaatgctgaagaaaggtctccacaccgaagttggtcagagctgatccgaaaaataccggagagagttctcctttgctgaccatctcctggtcaaattccgcactcgctccgtccagaagctcaatctcttcttccagctgtgcgaactgtgcttcacttacgatgctctttgcttcctcactgtcgatggaaaccttctcaacttccccgatcgaggttcctttcttggtatctgagaaaatctccagttctctgctgttccggtcaaatacgccgcggaattcttttccggaaccgatcggccagttgatcggacaggtagcgatccccagttccttttcaatatcatccagtaattcaaaggtatccatcgcttcacggtccattttattgataaatgtaaaaatcggaatatgacgcatgacgcagactttgaacagctttcttgtctgtgcctccacaccttttgatccatcgatcaccataaccgccgaatcggccgccataagagtacgataagtatcttccgagaaatcctgatgtcccggtgtatccagaatattgatgcaataaccgtcatactggaactgcaggacagaagatgttaccgaaatacctctttctttttcaatctccatccagtctgaaaccgcatgtttcgctgttgcctttccttttacagaacctgcctgattgattgccccaccatataacagaaacttctctgtcagggtagtcttacctgcatccggatgggaaatgatcgcaaatgttcttcttttctttatctcattcgtaaaatctgccatgttattctactcctactattttctcaatgtcactcaaactcttattatatggtatttttgctataatatcaatcccctgattcactcgtatttgtactttcatggatcggtgtgatcaccacatttgcagcatttacctctgctttgcgtgtgacaatatcctcgatctgtgcccgttttgcatccgacagatccgccacatcaacgaccacatctgcggattcttcggtaagacttaccaccgcatcctgaaagcctttgctggcaagcagagtctcaattgcgacctcctgttcggcgcgctgtgtcatctccaccatctgcgcaactgcatctgctttctggtcttctgcgatatctgcattatcaatgatcgcctgcagggtttctttgttttttgcccgcacctgctcccggttcacttttgcctgtgctacaagcgcactgaccgatccatttgtcagcaccgcctctcccggatttccgtccacctgatcgttatccgctgtctggagggagctgtcacctcctgtgtcctgatccgaaatatccagaagttccttatttgccatctcgcttcccgtctctgctgttttgtttttcgagccaaaaatttttccggaatagttcagatatcctgccgcagcgatcatcaccgcaagaaccgcaatcacaatctgatttttcttaaatacttttttcactagccttcctcctataagattcttttttagttatgcttcattacttttatcttatgcgtgtctactccgaataatgcctgcacagcctctgtgatattttcaatcacgatggcattatctccgccatctgcaattacgagaacaccttctatccggggacttaattcctgtttcacatatggcgtttcttctccatttccgtttgcataaactgccgtctctgaagaactggtattttttcctccgctctccccttcctgcacctcacttgtcatctcctggtccttttccactaccttttccgaggaagaagccagagtgatcatcacctttacatttccaactccttctacttttgcaagtgcattttccagccgtgtttccagtgcatctgtataagtatcctccgatgcattttccgccttctgcacctgctgttcatcctgtgtctggtctgattttatatcggaaacaggcatcgcgatcacaaccagaagcagtccgacaagcaatatgatcagccacttgtctttttttattttacggatttcaaacatcttcattcaccgcccttttcgagcaaatccgccgcatactccatctcttttatcatctgctcatactccgccgtccgatacagctccgttacctgtccggcttcccccataagatccagaaccggctgggcaagcaaaactgtcagaagaagtccgcagaaaaaacggacatatttccggtagctattctctggaagtgcctgcaaaaatgcggttacaagaagcatataaacggcgagattctgcatccacctgtaaaccagctgtatcattttatccctcctacgaagctgccgatgccgcaactgcaagtgtcaccagaaacaggaccgccgtcgcaagcaccgtctttagcagcatatgataaccttccccggtaaaactgatggcctccacgatccgtttatcagacaccggctggataagtgccgccgttcctttgtaaagaagcgtcagaattcccatattgatgaccgggatcatcacaactcccgttacaagcagtgcccctgcaattccaactccattttttaaaaggaccgcacttccaagcacgacttcgcttgtcccgctgactacatcaccgattcctggaatcattcccacgccctttgtccagacactccttttcacctgatctgccgccggactgattatccgctcgataaacccgatccccgtcaccagggcaagcagacttttcagactccatccgattacaagtcgcaaaagttccgctgccttagaaagaaattcctcctccgtcagattgttcaagatttccatcagaagtgcgatctggatcaacggaacgatccatttcaaaatcacaagttccacaagaaagatcaggaaaagcgccagattataaaatgcgatcgcagaaatacttcccactgcgactgccatacagacaaagtagacaggacagagtactcgcataaagaggatcagattttcgagtccatgctgtacctctacggctgctgcctgaaaattccgtatgccgactgtaatcacagacaggtataccagaaaaaaggcggtctgtgagatctggcagttctgaaacacttccgaaaagttggaaaaaaccgctgcgatcagcaccagaaaaatgatagatgcaagcaccggtttattgaccttcagcacatagaaaaactgatccgtcacaaagtttctgatctgtccggcagacaggttctcatcctgccggatcacagactcaacaagatcctgaaaatgcagtttttcttccgggaacagttttcggattgccgtatccagatcctttacctctgtcagctcccagattttctgctctgtttcctcctgtgttttttccagatccgtttctgtcatattatcttctgtccggctgttttccgaagaggaatcttcccctgccgcaaatacctgtaccggcagtatcagtacgaagattacaagtccgatcatgcatgctatgccatatttctgaaaataatgtttcatttttcttcccttttactgtccaagttcgcggattgcaagaagcagtgcttttaatatcggcattcctattgcaagtatactgagccttgcaaagacctcgatctgctcggcgatcgtctgataaccggcatccttgcagattgctgacgcaaattccgccagataggtcacacccaggattttcagcattgccgtcagatataccgcatcgatctttacaaagctgccaaccaattccaaagtttcccggatcaccgacagattccggctcattccgagaaaaaggaaaatgctgaccgcaatccccagatagatcccatactcttttctggtattttgaaattgtaatgccaggaaagttcctgcaatcccgatgcaggctgccttaaggatactcatcttttccctcctttacagagcaaagagccgtctgatatcgtcaaacagatctgaaatataaggaaggatccagaataaaaccaggagcagtcctgcaaggcttgtgagaaatgcctgttcttctcttccgctgtgtttcagcacctgtcccaggacagaaaccagaatcccgactgccgcaattttaaatatcagatttacactcatgtttcgctcctatttacagaatcaaaattgtcaggaaaagccctgctgtaacacccagcagattgcaaagcctccgtttttcctgaatttcttttaaaagaccgcctcttttttcttccagaaattctgcatactgcaagaaaatctgcgtttcctgcttcttatccaggctgccaagctgcatcccaagctcatgcagacgtaccctttcctccctgccaaggagcagacattcaagatcactttcgcagcacctctcccagattattgcaagacttcttgacggcatctccaattcttttgccagatgttccaaccagatccctggagatgtgttgaaagtaatcgatgatctgggtgaagtaccggatctgatcatattggatccaccaagagacggtgtgcatccgaaagcactggaaaagatcattgattttggtgtggaaagaatggtttatattgcctgcaagccgaccagcctggcaagagatctggagcttctgcagggaagaggatatcaggtagaacggattgggtgtgtggatcttttcccgggcacttatcatatagaaacttgtgttttattgtccaaactaggataaaagctggcagattggtaaaaggtattcgtaatattgcagaagagattgtgttaaaagaattggtgtatatctaaagcgtggaaagctccttcaggagtttttggctgtttataagataaattctgtcggagatttattataaaacattactttacaagaagaataaaaaagcatataattcttttataatatatttaataaaagagggtaagaaaacggaaaataaagataagaaaaatacaacaagaaaaaaaataattaattatgttctaaacaatcatgttacatccaaggcgggaattgcaaaagagttaaacttgagtatgccgactgtgttagcaaatgtgaatgacttgttagaaaaaagggtgttggaagaaactggggaatatgcttcaaccggtggaaggaaggcaaaaagtatagggattaataagtcatactgtcatgcaatgggaattttgattacagcgaatcatatagaaatggtattagtaaatcttggagatgagattataaaaaaagatcgcattcgttttaaatttacggcagaattatcctattgtacagaggtggcacaaaaggtcaaaacttttcttgaaggcgaagcagcgaaggacacgctacttgggattggagtggcgattccaggaattattgatcagaaagaacggattgttttaaaatcccatgctttaggtatagagaattatagtctgcgctttttagagcaggcgctggaaattccagtatattttgaaaacgatgctaatgctgcaatgcttgcagaaaaaaagcaaaagtatccaaatgcgatatatctgtctttgaaccacaccttaggaggtgcattctgcatagatggaaagctgtttcgagggcaaaaccagaaagcaggggagtttggtcacatgatactcgttcccggtggaagaaagtgttattgtggtaaatcaggatgtgcagatgcatattgtgctgcaagtgtactgacacaagataacaggcagtcactggatgcatttatggaaaaaattgaaagtggtgatgaaaaaaatttgcagacatggaatgagtatctggatcatcttgctgttttgatatcaaatctgcggatggcatatgatatggatatcatactaggaggtgatgtgggaggtgtattgtcagattatatgataccactgggagaaaaagtgatggcatataatggctttgagcatgatgtttcatacttgaaaaattgttcgtataagaaagaagcgtcggctgttggagccgcgaaatacttttttacaaaacatatggtagaattgtaaattttttgaacgaagataagcagtacaccgcatttggtgcgtagggtaaggggatgtttagtctgttggagttaaaagctcccactgacaggttgcaaagcgaatccggatgtccgctttatatgtgtgaaaaacgagaagttgtgtaaaattaaaaaaagatattatagtaaaaaacggaaagaaaacagtaactacggttttctttccgttttttttgcgtgttaattgtgaaaaatatacaaaaaatgtgttttgaaattatgaaatatataaaaatatgaaaaaacatattgacaaattgtgtttacattgtaataatataattactttaataaaacattttataaaacataaaacaaaacaatatgaaagggaggaaacaattatgttacagcaggtaatgacaaatccaggagaaattattttcagagaggttccggttccggaggtaaaggaaaatcaggtgttggtaaagattatgaatattggtgtttgtggatcagatattcatgtttatcatggaaaacatccatttacaaaatatccggtaacacagggacatgaggtttccggtgagattacagaacttggaaaaaatgtcacagagtttcatgttggacagaaggtaacgatagagcctcaggtatattgtggacattgctatccatgtcgtcatggaaagtataatctctgtgaggaattaaaagtaatgggatttcagacgacaggaacagcatctgagtattttgcagtggatgcatctaaagtaacacctattccagaagatatgtcctatgaagaaggcgctatgatcgaacctcttgcagtggcagttcatggtgtaaaacagatgggagatgtggctggcatgaatattgcagtccttggagcaggaccgattggaaatctcgtggcacaggcagcaaaaggaatgggggcagcgaaagtgatgatcacagatatcagtgatcttagactggcaaaggcaaaagaatgtggaattgatgtgtgtgtgaataccaaaaataaagacttcggtgcggcaatgctcgaagcatttggaccggacaaggcggatgtgatctacgactgtgccggaaacaatatcacaatgggacaggcaattaaatatgcaagaaaaggaagcacgattgtactggtggctgtttttgcaggaatggcagaagtagatcttgcagtggcaaatgaccacgaacttgacattaagagcacgatgatgtaccgccatgatgattacatagatggaatcagattggtaaatgagggcaaagttcatttgaaaccgctcatctcaaagacatttgcttttaaagattatctgaaagcataccagtatattgatgataaccgcgagacaacgatgaaagtaattatcaacgtcagtgaaaagtaaggagttcgtatggaaaataaatatggaattgtcggagttgcccatgtcgggcttccgacaaacgatttacagaaaacagttgagttttataagagtcttggatttgaagtgattatgcagtcttataatgaaaaagcaggggaaaaagtggcatttttacagataaaaaattactgtatagagacttttgaaaatgggcaggcggcaatgtcagatggtgcataccaacatgttgcacttgatgtggaagacattgaaagtatgtatcagaaaatctgcaatgaaaaatacacaattattacagacggaatcgaagaactaccattttgggaaaatggtgtgaagttttttatgattaagggaccaaatgaggaaaggatagagttctgtcagaaactctgataaaaataggaggaacatatgggaagcgaaaacaaaaatggaaaagtaccgctgatcagtaagattgcatatgggtttggtgatgttggatgtaatttcagctggatgttcgtcagtaattttctgatgatattttatacagacgtgttcggaatcagtatggcggctgtgtcagcacttatgcttttttcaagattctgggatgcaatcaatgatccaatcgtcggggggcttacggataaaacaaaatcgagatggggacggtaccgtccatggctgttagtagcggcaccaattacagcgattcttcttgttatgacattctgggcaagacccgactggccgcagaatggaaagatcatttatatggtaattacatattgtctgctggttttgggatatacctgtgtgaatattccatatggaaccttgtgtggtgctatgacacaggatattgatgaacgtgcaaaaataaatacatcccgttcggttgcagcgatgattgcaattggtgtgttaaatattattacagttccactgctcagcaaattcggcagtcatagtgcaaagacaggatatctgacggttgcggttatatatggatgtatttttacagcctgtcatttcttctgctttgcgaagacgaaagaggcagtgattactccggaaaaagaaaaaatttctgtaaagatacagttgaaagcagtcatgcagaacagaccatatcttcttgcattggcaggacagatattatttggatttacattgtatggtagaaacgcagatattctgtattactttacatatgtggaagggaatgcctcctactacacaacttattcgatgtgcatcattattccttctatcatcggggcagcctgttttcaaccattattccgcaagttgaataacaaaggaagaacagcatctctctttgctttatttacaggaatttccatgttgtctatgtttttcttcaatgccaaagaatcaccggctattttttatgcattatctggtctcacacagttttttttctctggatttaataccgcaatctatgcaattattccagactgtgtggaatatggggagtggaaaaccggacttagaaatgatggttttcagtatgcatttatttcacttggaaataaaatcggaatggcagttggaacagcacttttagcaggattacttggaaaatatggttatattgcaaatcagacacaaaatgcaattgtactttcaattatgaaacatgcatttacaacgattccaggtgtactgtggattgtgactgcggttgtattatttttctaccgtttaaataaaaaacgttataacgagattgtggaggaactgaaaaatggaagaaaaagttgatatcgtggcattgggtgaattgttgattgattttacggaagcaggacatagtcaggatgggagaaaattgttcgaacagaatcccggcggtgctccggcaaatcttctaaccgttgcaagccactttgggtatcgcacatcttttattggaaaagttggaaacgatatgcatggtaaatttttaaagaagacattgcaaaaggaaggaatcaatacagatgctattgttgaagacccgggttattttacaacgttggcatttgtggaaatcggtgaaaatggagaacggaatttttcttttgcaagaaaaccgggtgcagatacacagttaaaaaaagaagaactggatcagacattaatttcaggttgtagaatttttcattttggatcattatcgctgacagatgaaccggcagaaagtacaacgattgaagcggtaaaaatggcaaaagcagcgggtgcacttatttcctatgatccaaattatcgcccgtctctttggaagagcaaagagcatgcagtgaaaaaaatgagatctgtcatagaattggtagatgtcatgaaggtatcggatgaagagagtactctgttgacagaagcgaaaagttatgagcaggctgcagatcaactccttgccatgggaccaaagctggttgccattacattgggagaacagggcgttcttatggcaacaaaaagcagaaaagaaatcatcaaagcatttcagatacatgcggtcgacacgactggggcaggtgattcattttggggaggcgtattatgcagtctcctttctatgaataagaatgttgaaaaaatggaatgggaagaaatcaaaaagtgtgctgttttgggaaatgcagttgctggattgtgtgtgcaaaagagaggtggaatccctgcgattccgacgaaagagacagtgtttgaatttatgctcaaaaagcttatcagatgtttgtagacaatctgaagaaaagtgcaacaacaagagcgtgcatatttgcaagcttttttgaaaactgtcgtttggtaaaatttattctatttttaaaagctttgcgataaaatatgttctgtgaatcattcacagtattgtattttgaggagacttcattcatggtgagtgaagtctcttttattttgcactgtataatggaaaaagttttggttgaacagcagttggaatagtgaacgcatgcgttcacattttataactaagaagtaatggattggaaagaaaataatcaagaacttattgtagtattattaacctttgatacagacgaaaaaggtggagatggtggggtcaatcctaatgctacatataccaactggcagtggaatttagtgaaaacaaaagataaaaagaattgggaaataatcagttgaggttattaatcgattccggtttgatgaattcatgtggcttttgaaatggtaaagtgattttattttacttattccggagcgtggtatatactaataggtaaagtaagtaacgcacagatgtgacaaaattgtctttttaaatatagacagccttgtgaggggaacgctgtacggttaggatactgcataaaaagcaggaaagaataacgaaaaacggaggaattaaaatgaaatttcaaaagcttggcaacacggacctcgatgtttctgtggttgcattaggtacttgggggcttggcggcggaagtgtctggacagacggagattctacagttgaggacgtgaagagtctgcttgatatttgtcatgaacatggcgtgaattacatcgataccgcaccggtgtatggcacaggagtaagtgaggaattgcttggtaaggcactgaaaggcagaagaaatgattttgttttgcagaccaaatgctctctgaactggagaaatgagggcggtaattttcattatgaacgagacggttataccgttaacaatgacacccgcgcatcagcagtgaaaaaggacgtggaagactctctgcgcagaatgggaaccgattatctggattctgttatcgtacattatgtctgcggcagctttccggtggaagaaactgttggagcattggaaaatctggttcgtgaaggaaagatccgtacctatggactttctaacagtcagccggcagatctgtctgcatatcaggaagccggcggaaacgtatctgttgtacaggaatttttcagtattctctctcctttccatggcagaaaatattttgatctgtgtaaaaagtataacacggtatttcagacctatggtgtgctggaggaaggatttttaacttctcctgcctttatggaacgtgaatttgcaaaaaccgatatccggtccagaataccttggacagatccggagaaaaaagaaggacttcgcagggcttttgaaatctggaaaccactttgtgaggaatatcattgcagttttgcaacgctggtagaagcctgggcattatctcagtacgaccggatgagtcttctggttggaatgcgaaaagcttccagtgtggaagatactgtaaagtgcttggatattaggttgcgtgccgaggacatcaaatgtatggaggaagcagtaaagacaattcaggttgcggttttggacaaatagaaaactgaaaaggtggaaaggatcgggagcgtgtatccgatcctttctttatcgagaatagatagcatgaaaggaaaataagtatgaaagaacctatgatggcagacagccatgaaatcacagttagaaactataagcaaccgatgcgaaatcgtctgatcatgatgctgatctgcattgggattgctcttacatcattttttgttgtttccaaatgggcaacttctgtcgaatcgtaccattgggttatcaaaacgctgaatggattgcagaaaaaagcacttgggctttccggaacagcaaccgctcttgcaacaggtgctgcagcaataccgggagaagccgcaactccgatcgcgaataagctggcagatgtcgcaggctatatggtgatcgtttatgcagtgatcattgttgaaaaatatttactgactatcaccgggtatattgcatttaaaattttatttcctatcggatgcgtgcttctggctgcaggaaattttttgaaaaacggatggaaggaatttatctataggatcggaattaagagtatcatactgggagttcttttgtggggactggttcctaccagtgcatgggtgacgaatatggtaaatgaaacctatgcaaagtcctatgaagctgattttacactggaagatacggaagaattattagatgagggagatacctctgcaaacgcagacaagaaggatgaagcacaagaaacgaaagataaaaagttttctctcagtgaatttcttaataattcgaaggataaggttgatgatgcgattgatgcggtaggtgaagtcgctacagaaaaactctctgcttttgaggatggattaaacagaattatagagggcgtggcagtgctgcttgtgacaacctgtgccattccggttctggtcatgttatcatttacttggattctgaagggaataatgggtttaaaaattccatctattactcttcagtcagtgccaagggtttctgaaaggaaaagaaagaaaacggaagagaattaattttaaattttaccgaaggagaggaatgagatgacaaaagatctgacaaccgggaaaatcatgccgattcttgtgaatttcactgtgccgcttgttttgggaaatctgtttcagctgacttataatgcggtggacagcatcatcgtagggcattttgtggggaaagaagcgctggcggcagttggtatctgtaatccgatcagtacgcttatgatactgtttttaaatggattatgtatgggggcaagtatcctcatgggaattcagtatggggcaaaggattataagactttgcacaggcagatcagtacaaccatgttgtcgggagtagttttttcattttttctgactttattttgcgtggtatttgctgtaccgatcctgcatctgctgcaggtagatgcatcgattatggagatgacgcggcagtatttacggattatttttctgggattaatgttcacctttttgtataactttttttccagtaccttaagagctttgggagacagtgcatcgcctttgtatttcttaattatcagtgcagtcctgaatatattcggagatctgttttttgtcattgtactaaaggcaggaagcaatggatgcgccatttcaacagtgcttagtgaggcactgtgctgcctgttctgtattatttatatacagaaaaaagtaccgattcttcgtctgggtaagaaatggctggtattcgattcacgtttgctgaagaaaacaattgcttacggatgggcatccgccatgcagcaggccaccgtgcaaatgggaaaaattgcgatccaggcgctggttaatactatgggagtttccgtggctgcagcttttgcggtggtcaatcggattgatgactttgcaattacaccggaacagaatattgcccatgccatgacggcacttatggcgcagaataagggagccggaaaaaatgaccgcatgcgggagggatttcgttgtgggatgattctggaaattgtttatggagcagctgttatggtgatctgccaggtatttgccggagaactaatggcacttttcgtaaaagatgaggaagtaataggacatggtgtcatttatctgcatctgattgccgtgatgtatattcttccggccgttacgaatgcgattcaaggattcttccgtggaatcggagacctgaaggtgacactgatgagcagttttaccaatatggcagtccgagtcattgcagcagcacctatgattttgttgtggaactttggaattgaagcgttgccatattcctatctggcaggctgggttgccatgcttttggtagaaacgcctttgatgattcggatttatcgtaaaaaataacaggatttaaagaaaatataaaatcgctcagggaatgagcttatacagaatccagttctaatctttttataaaagccagtggtgtcatatggtattttgctttgaatgctctgtaaaaataagaaagattatgaaagccaacagataaagacacctctaatatggaggtgttaccgtgttcaaataactctaccgctttttccagtctgatattgttaatatactgaatgcaggtcatattcatgtgttttttgaaaaagcgcataaaatgatactcgctgaaataacatagctttgcaagttcagaaaccgacagagcttctgcataatgcagatcaatatgatcaagtacaatttttaatttgtcggaagagtctgattccgtggagaatcttgtgctactgtactggagcagaagaaaaagtgtctgcagcagataagattttatagcgagttcatatccaaacatccgggtatcgtaaagggaggcaagctgtgcaaaagacttgcaaagagaatcatatgcaggatgatccgcggtaatgagacaggggaaagataattcgtggtttaccatgggcgtaaggtagcgggtagaacagatgtctgcagtatttccacccaaaagattcatatggaatacataggtttccgaacagaagtcctgactgcttttcaggataatggaatgcagcagcaggggaggaataaacaggatatccccggtacttgcttcatattcaattaaatcgatctggtagacacaggaaccttttgttataagtgtaagctctgcttcctcgtgccagtgcattgttatgacaggtgcttcttttgtcagctttgtaatatacttctggattggaaaataaacttctccatgtttgatattttctttttgctccggtataagtgaatgtggcgttttcattttttgtcctctccataatagcagtattgtgttatataatgaaaaaataatgcaagatttgtcaagaataagatcttataatagcagtataatacagctaaagcaataacgcaatggcgaacaaatactatgattatatatgaaagaggttgataaaaatgggaaaaaagtggtggcatgacaaagtagcgtatcagatttacccaaagagttttctggatacaaatggagacggaatcggagatctgagaggaattatttctaaactggattatctgaaaaaattaggaatcgatattatttggttatcacctatttataaatcaccatttgtagaccagggatatgatattgcggattactatgcaattgcagaagaattcggaacaatggaagaatttgatgaactgctggcagaagcaaaaaaacgagacatgcatattattatggatctggttattaatcattgctccgataaacatgagtggtttcagaaagcacttgctgatccagatggagcgtttgcggattatttttatttccgcaagggaaaaaacggcaatccaccgagcaattaccgttcctattttggaggaagctgttgggaaaaggtaccgggaacggacaaatattattttcacatgtttgcaaaggaacagccggatctgaattgggaaaatccgaagttacggcaggaactgtacaaaatgatcaactggtggctggaaaaaggtctctccggttttcgaatcgatgcgatcataaacattaagaaggatctgaattttcctgattttacaccggatgggaaagatggtctggcaagctgctggaagatggttgaaagtgtagacggagtaggagagctgttggaagatctgaaaaaatcaacttttgaaaagtatgatgcctttacagtcggagaagtatttaacatgaaaccggatgaattaccggaatttattggagaaaccggtcatttttcaacgatatttgattttagcgcccatacactcactgatggagaacatggatggtatgatgctccgaagctggaatttgcgaaatggagagctgcgatcattcaggcacaattagaaacacagaagtatggctttaaggcgaatatcattgaaaatcacgatgagccaagaggggcatccagatttttgccatcttatgctcagacaccggacggaatcaagatgcttggtaccataagccttctcctcagaggaattcctttcatttaccaggggcaggaaatcggtatgagaaatgccaaatggaacagcatggaggaatttgatgatatcagtacaaaagaccagtatcatattgcccgtgaagcgggattatcggatcaggaagccttggaagtatgcagccgtatgagccgtgacaatgcaagaacaccgatgcaatggacaagcggggaaaatggcggttttacaaaaggaattccatggttaaaggtaaatcctttatttaaagacgtgaatgtggaagctcaggaacaggatccggattcagttttgaattattaccgcaaactggttgcactgcgtaaatcggatgaactgaaagaagtatttacctatggagaatttcttccggaatatgaaaatgtggacggagtcatggcattttaccgtaaagatgaatccaggtgcattcttgtggctgctaatttcggaaaggatgctgcaacaatcaaactgaagagcgaaatcgaaaaagtatggttatcgaaccgtatagatggaacggtagattgtgaaaaggattcattgaatttacggagctgtgaagtggttgttctggagctggaaaaccacaagtaactaactatataactcccggatctctttttgaatcagacgtccagctgcttttgaaagctgatcaatctggcggatcctggtaaattcttttccgtaaatctgtttagcatttgtcgcttcgccatcgtttcccataaagacggcggatacatgaattccgtttttgcgaagcgctcttacctctgctgcagtatccttgatggcagcatgttcttcgtaagcagattcgaaaggagcatttgatgtcggatatttgatttttgatttgattgccgctatcattatcttctttggaagctacactccggtaacactattcagtaaaacaaaaccaaaagtcagattactgatgattctgaagacatgtgcgtatatgtggatcattgctatggggcttcagcttttattttagaaatatgataaatcagggattgaccttgctggattatatgcagcggatcaatccctgcttgttcttttggaaatgcgtttgatcaggcaacgagaaatatgggaagaggtccgggaggaccgcgtggaagatatggacagatgggcggggctgacagatggggaagaacgcctggaggaggtgtacctccgtttggaacttacaggtggagcggaacggatggaaatggaagagcatggaatccggatatgcaggactataaggcggaatcacagggcagcagccggtatggatacagcaatgcacagcagtcacctgtcttgtatggatcgacgacgggaacaaaggcaggcggaattgtcatgatcgcagtaggcggaagcatagcacttatatttctgattctgttccttgcatcttgtattgcttctttgccggaaagtccgggggctttatggatcatgcgtgcggtatttggactgtttacggcagcaagtggcatgatcacaggatggggcattaagcttctgaaacaggttggaagattcaagaactacagccgcaggattgcaggcagagagtattgcaatatttcggagatcggaagcaattccggaaaatccataaaatttgtgacaaaggatctggaaagaatgatttctaaaggctggttccgtcaggggcacatggatggtgagaagaaatgcctgatcctgtcaaaccgtgcttatgaagaatatttacagatcgaaacccgcagacagcagtcgaaagcggaagagccggtaaagaaagaagagaagacacaggaaaatacaaaagaaaaagaagcaaagaatgaaaagctggcaccggaggtgcagaagatcattgaccagggggatgcttttatcagaaagatccacgagtgtaatgaagccattccgggagaagagatttccgcaaagatcagccggatggagatgctggtagaccggatcttcgaccgggtggaagaaaatccacagtcagtttcggatatccgtaagctgatggaatattatcttccgacgacgatcaagcttctggaagcatatgaacagcttgacagacagccggttgatggagaaaatatccagactgcaaaacgtgagattgaggcaacgctcgatactttaaatacggcgtttgagaagcttttggatgacctgtttcaggataccatgtgggatgtctcatcggatatttccgtattgaataccatgcttgcacaggaaggtctgaaagaggacggaatgaaaaaataaagttgcaggaggaagaagagtatgaacgattttgaagaatttagtgtgacaccggagctgacgctggatccgttccaggaagaaaaaaaagagactccgcagatttatcaggagacagaaccggaaacaccggagatcgtcctgacaccggaagaaaagaatatggtcagtgcatttgcagaaaaaattgatctcgccaattcgaacatgattcttcagtacggagccggaacccagaagaagatcgcagatttttcagaaaaagcactggaaaatgtaaaaacaaaagatcttggagaggttggcacactgttaagtgatgtggtgacagaactgaaaggatttgatgaggaagaggaaaaaggattcctcggaatcttcaaaaaaggcggaaacaagatccaggcaatgaaagccaaatatgcaaaagcagaaaccaatgtaaacaatattgtcaaagcactggaatctcacgaagtgcagcttatgaaagacattgcgcttctggacaagatgtatgaagtgaacctgacatattataaagaattggccatgtatgtgcttgccggaaagcagaagcttgccgagacaagaaacggcgagctacaggaactgaagaataaagcgatggcaagtggacttgccgaggatgcacaggcagcaaaagatctggattccagatgtgaacgttttgagaaaaagctgcatgatctggaactgaccaagacaatcgccatgcagacagcaccacagatccgtctggtacagggaaacgacacaatgatggcagaaaaaatccagtctacactcgtcaatacgatcccactctggaaaagccagatggtactcgcccttggtgtagaacattccgcacaggcagccgcagcccagagagaggtcaacgatatgaccaatgaactcctgcgcaagaacgcagaaaagctgaagattgctactgtagagactgccaaagaatccgagcgtggaatcgtagatattgaaaccttaaaagcaaccaatgaatcgctgatcgcaaccttcgatgaagtcatgcagatccaacaggaaggccgccagaaacgtcagcaggcagaggtggaaatgcaacgcatcgaagctgaactgaaagcgaagctgttacaggttcaggggtaagcgtttggtggatgacatacaggccggaacaagtagattctgtttttttatgaggagaaagcggcgaagagtccgtaggtaaaaaggtagccggtaattttggataccggactgattcgctgaataatcttgatgattattcggctcagcagtcctctggatttcgtgtatgaaacacgaaaccagatccaaattaccggctgcctttttacaacggactctaatcgtcgctttctaacataaaaaaacagaatctacttgttcctgccttgctgtattccacggggggacgcctggaggctgcccccgttatggggtgggtgcgagtgaatggaatagtagatagtaggaataaagtgcttgtgtgaatgtttctgaaattaaaagttatcaagacatagacataaaggactccgttttctgtgattagaaacggtgctagagtccgttagaaaaaatgcaccagtaattcggatctggtttcgtgctacaagcacgaaatccagagggctgctgagtggaataatcatcaggattattccgcgaatcagcccggtatccaaattactggtgcattttttctctacggactcttcaccatttctacccacagaaaacggagtcctttatgtcgtcccttttgtacagttattcaataacagttccggttttacccttcagagcatctttcagagtatcaaaagaagtaatcagagcacttcttccctctttcttttctatgaatcctacggatgcctggaattttggaagcatattgtagattccgaagtgtccttcatccatgtactgcttagcctgttctacggagatagtatcgagttcttcttcatcttcttttccgtggtttaagcataccttttctacactggtcaggatgatgagttcatcagcatcaatctgttcggcaagcttgccggcagtaagatctttttcgatgactccgctggcacctttaagatgattgttctgctggagtaccgggattccgccaccaccgcaggcgattacgatatgtcctgcatcggtaagggtgcggatggcatcaacttctacgatatcaaccgggtttggagaagcaacgacacggcggaagccctgaccaggaacttctactacataattgccctttttacgttcagcggcagcgtcttctgcgttcatgatacgtccgacaatcttggttggtgtatagaatgcttcgtcatatggatcaacagttacctgtgtgataacggtgcatacgctacgatagatgccgcgtccgatcagttcttcgcgaatcgcattctgcaggtcgtatccgatgtaaccctgcgacatagcagagcagactgacatcggagaagcggtataatccggatgattggtgctgaattcgttcatagcagtatggatcataccaacctgaggtccattactgtgtgtgattactacctggtatccttcttcaacaagatctgcaatggaaactgcagtttttttaacggcaaccttctgctccggaagtgtggttccgagtgcgcggtgtcctaatgcaacaacaacttttttcttcatattacatccctctgtttctcagaatttgaattgtctgcgtatgaaaaacatataacgcagacaacagcgataaaaaatatataaaaattatagtatttttttatggaaattgcaatcattagttggcaaaaatgcacagtataaaaaggaattattggtgggcagaagctaaatggcacaaggacggggatttttagaaaacatgctgacaacaaggggagatgttcatataatataataagaagtccgatggatggtgcagtatgaaagaggaacggattcgattttgcggattaaaagagcgtgaggtcatcaacatatgtgactgcaagcggctcgggtttgttgcagatctgcagatcaatatctgttcagggtgtgtggaagcattgatcgtaccgggaccgggaagaatctgtggaattcttgggtatgatgcggagtatattattccgtttgagtgtattcgcaggattggagaggatattattcttgtggaaattaaagaggacaaatgtctgaagccgtgtaaataagaatagtaaaagaggaagaagagtacagactgcttagtgaaataaatgagaacaagtaaaaagacaaaggagagaagaaaaatgacagcattttttaaagaaatcgagccattccggggaaacggaaacgaaaatgaaaagggacagacgttggaagaatttctggaagagtacgatccttataaatataagaatccttgtgtgacaacggatgcagttatattctcctgcaaaagaaaggtagtggacggagaatggaaagttctgatggttaaaaggcggaatcatccgagcattggctggtgggcgctgccgggtgggtttattgaacttcatgagaatctggaagatacggcaagaagagaactgaccgaagagaccggcgtggcggatcttccgatggagcagtttgcagtctatgggaatgcgacccgtgatccgagggcacggattattacatcggcatatctttcggttgtggatgaagggcaggtaaaggtgcaggctggtgacgatgcggcggatgcaaggtggatgcagcttcattgtcagacagaatcggtgaaggaggatggagattggaagagaaccatttatcgactggcattggaaaataaagaagcagagcttacaatttcggcgatcgttgaaaaaaaggaaagaagtggactggtaagagagacttattataaggtaaaagaatcggaccggatcgcctgtgaccatgcggcactaattgtacaggcatggaagctggtggagagccggcttatatagccttttgataaagtgtgaatttgttgacaaccctgtatacaggatttatactatagacattaaaaatgtgcgtgattcggcagtagaatcaatcaagaaccaggcaggaggaaaaaagatgaagtgcccatattgtggtaacattgatacaagagtcatcgactcaagaccggcagatgacggaacgacgatcagaaggagaagatcctgtgatgcgtgcaacaagcgttttacaacctatgagaaggtggaaaccataccgctgatcgtgatcaagaaggacaacaaccgggagcagtatgaccgtactaagctggaaggcggagtactccgggcgtgctataaacgtccggtagcggcagcagatattcaggcaacgatcgactcgatcgagacagcgattttcagccgggaagagaaagaaattccgagcagccagatcggtgagattgttatggaaagtctgaaaaagctggatccggttgcttatgtacgttttgcatcggtatacagggaatttaaagacgtgaataccttcatggatgaactgaagaaaatattagaataaaaggggaaagacaaatggaacggaaaaagacagtattgctctgcgtgaccggcggtatcgcggcgtacaagattgcaacactggcaagtatgctggtaaagacaggatacgatgtgaaagttgtgatgacacagaatgcaacgaattttatcaatccgctggtatttgagacgctgacacagcataagtgcctgatcgatacatttgaccgcaattttgagtacagtgtagagcatgtgacactggcaaaatgggcagatattgtgatgatcgcacctgccacggcaaatgtgatcggcaagctggcacacgggattgcagatgatatgctgactacgactgtgatggcatgtgccgaatgtaagaagatccttgcaccggcgatgaatacaagaatgtatgagaatccggtcgtacaggataatttaaaacttctggagcattatggatatgaagtgatccagccggcaagtggacatctggcatgcggagataacggagccgggaagatgccggaagcggagactttgtatgaatatatttaccgggatactgcttatgagaaagatctgaccggaaagaaaattcttgtcacagcaggaccgacaagagaagcaatcgacccggtgcgctacattacgaatcactcatccggtaagatgggatatgctcttgcacgcgttgctgtggcaagaggagcggatgttacgcttgtcaccggaccgacagagatcaaaaagccgatgtttgtgaagattgttccggtcacgactgcaaaggaaatgttcgaggcggtaaaggaagaggcagcagatgcagacattgtgtgtaaagcagcagcggttgcagattaccggccaaagcatattgcggatgaaaaggtgaaaaaatcggacagtgagatgagtctggaactggaaaagacagacgatattctgaaatatctcggagagcacagaaaagacggacagtttctgtgtggattttcgatggaaaccgagaatatggttgaaaattccagaaagaagcttgaaaagaagaagctggatatgatcgcggcaaataatcttaaagttgccggagcaggatttcagggcgatacaaatcagatgacgctgatcacgaaggaagatgagactgcacttccaatgatcagcaaggaagagacagcagcttgtattcttgacaagattctggagtgtatgaataaataaaaaagccaaaatgtattgtatctcgtaaagagaatagtaacaggaggaaaagaaaaatgaatcaaggcaatgaacgtactacatccatgtccaaaacaaaaggactcgtacagatggcaatctttgcagcacttattgtagtgctggcattcaccccgtttatcggatatatcccattgggatttacaagggcgacgatcatccatatcccggtgatcatgggatctctgatgcttggaccgaagaggggcgcagcgcttggaggcgtgtttggttttacaagttttatcaataatacgataaatccgacattgacatcattcgtatttaccccattttacagtttgggtgaatacagtggagggatcggaagtctgatcatctgttttgtgccacgtattttgatcggtgtagtaccgttttatgtttaccgtctggttaagaagctttcaaagaacaatggagtatcctctgttggactgattgcggcaggactttccggagcactgaccaatacgcttcttgtcatgaatcttatttttgtatttttcagaaatgattatgcggcagccaatggtattaccgtaaaggcggtatatggatttattctgagcattatcggaatcaatgggattccggaggcgatcgtagcggcggtgatcacgctggtacttgggaaaacactgatgaaaaaaggggtacaggaaagattaggagtgtaaaaaatgatacttgcgattgatataggaaatacaaatattgtacttggatgtgtggatgacaacaaaacctattttatcgaaagactttccacgatcaagacaaagatggaactggaatatgcgattgatatcaagatggttctggatattcacggaatcaaaccggagaagctggaaggagcgatcatcagctcggtagttccgcagattacatatgtcgtaaaagaggcggcagaaaagattctgaaaaaagagacactggtcatcggacctggcgtgaagaacggactcaatatcctgatggataatccggcacagctcggaagtgatctggtggcaaatgcagttgccggaattgcagaatacaaagcaccgatgatgattttcgatctgggaacggcgacaacagtcagtgtgattgatgaaaagaaaaattatatcggaggcatgatctatccgggagtgaatatttcactgaacgccctgacggaaaatgcatcccagcttcagggaatcggtctggaagcaccgaagcggattgtcggaaagaatacgatcgaatgtatgaagagtggtgttctctattccagtgcagcggcaattgatggaattattgaccggattgaggaagcgattggacagtcgatgactgcaatcgcaacaggtggactttccaagaagattgttccgtactgcaagagagaggtcatactggatgacgatctgctcctgaaaggacttctgatcatttaccggaaaaacagataacagaaaggtgacagggacgaggacttataaagttttcgccccttttataaaaggatgaatacttaccggataacagttgcctatgatggaacggcgtatcgtggatggcagagacaggagaatacggaacttactgtacagggaattctggaacggcggatttcagaaattgcagggaaaaagacggtggttagtggttcgggaagaacggatagtggtgtacatgcgttagggcaggagtgcagtctgtatctggaacaagaaattgatatggacagttttaagaagcagttaaatgtacttctcccggaagatatcagagtgctggatatcagcagagaaaaacgggattttcatgcaagaaagagtgcggtcgggaaatgctatgagtatcagatcgatctgcgtgacaagatggaagtatttcatcggaaataccggtttcattttccacatccggtcgatatcgctgcgatggaaaaagcagcagagtatctgatgggaactcacgatttttccgcctttacggatttgaaagaggacaaagatacggtacggacgatttatgcggtcgggatcgtgtatgaaaaggatacacttacgttatcgtggatcggagatggatttttatatcatatggtccggatacttaccggaacgcttctgaatgtgggaatcgggaaaataaaagcggaagagataccggagattctgaaagcgaaagaccggaagaaatctggttttccggcaccggcgaagggactgtttttaggccgtgttttttatacagaagcggagcttaaaaaagcggtacagaagatcagcgaaaaataaaaaccaaagaaatggaggaaagagaagagatgaagtttatttcatggaatgtaaatggaatccgtgcatgtgtgcagaaaggatttatggatttttttaaagaggcagatgcggatattttctgtctgcaggagacaaagatgcaggaagggcagcttgtacttgatctgccggaatatcaccaatactggaactcggctgtgaaaaaaggatactcagggactgcaatttttacaaagaaagagccgttatcggttacttacggacttgggatagaagaacatgatcaggaagggcgcgtgatcacactggaatttgaggatttttattttattaccgtgtatacaccgaactcccagagcgaactggcaagacttgactaccgtatgacctgggaagatgcgtttcttgcttatcttaagaagctggaagagacaaaaccggtgatcttctgtggagatttgaatgtggcacacaaagaaattgatctgaagaatccaaagaccaaccggaagaatgccggatttacagatgaagagcgagcaaaattctcagcacttctggatgcgggattcattgatacttaccgctatttctatccggataaagaaggaatttactcctggtggtcctaccggtttaaggcaagagaaaagaatgcaggttggcgtatcgattacttctgtacatcaaaagcactggaaagcaggttggaagatgcgaagattctgacaaatgtatttgggtctgaccactgtccggtggaactggattttaagtaggggtgagatcgataagctgcgacatcaaattgtaaaaaaataaactgatcagattcacttttgtgcgatggaatctgatcagtttatttttttgaaatttttcgttcagggatagtggatgattctgtttgagggaatatataaaattctgcctgcatataaatatacatgggtaatttagcttttgggatgaggagggacatgtatggaacggattggaagtatctggacgacgatagttcggtatttgctgctggtgatgtttggtggagtgattgtctgggcgtgcaatagtgcaggaatatcggtttacgcagatgatggggagacaccagatggagcagagctgatccggtttgattttcacaagtcggtaaatcaggaggttgggatcccggcaggaataccaggatttttcacttatttttatgaaggaaaagaataccattacggattccggtttgacagaaatgggacagggccagaaacagaaaagtttggtacggcatatgtctgggcaccttatacggttatttattatgacgctgcaggtggtgagatcgagaattacggtacggcaacagcaggcggaagaaggctgtttgcaacacggggaaatggtgaagagcttgaagccgggcagaataaaggaaagaacaaaagaaaatttgcggcagactatactgtgtatgggcagagccttcggttaagtgaaggatgtatgccaacggcagtgaaagacggatatcgatttgaaggatggtatgcgtggactgatgctggagttgtgcaggaaaaagaactggcagagcttgcaaaacaggagcagtatgggacacttgaagatgagctgaatgagaaatatacggagcagacgaagcttctggaaaaccgggaatccgaaagatacccggcatccagtattacactttacgcgaagtgggacaagatctgggagtaggagttagatatatcctccgtccatacccagtatctgcccggtaagataggcaggggcatttgcaagctgccatgcgagaagcgcgacttcttctggtgtcccgaaacgtccggcagggatttcttctgcgagggcagctttttcttccgcatccagaagatcgttcattacggtatcgatgacaccacaggcgatcgcattgacctggatattgcttggcgcaagttcctttgcaagtgcgcgggtaagaccgttcagaccggatttggtggcagaataagcgacttcacaggaagcaccgacagttccccacatcgaagaaatattgatgatacgtcccgctttctgatggatcatgtaaggaagtgctgcgcggcagcagtaaaatgcggaagaaagattagtggaaatcattcggttccattcttcaatgctcatatccgtcagaagtcccatccatgcgattccggcattgttgatgagtacgtcaagaccggagccggacatttcaatctggtcaaagatacgtccgacttcggatggaacacctacatctcctgggaggatttcgcaggaaccggaggtttcctttgtgataaaatcagcagtagcctgcaattcactgatggatttgctgcagtttaaaaatacatgccatccctcttttgcaaagtggatagcgcaggcttttccgattccacgggaagcgccggtgacaagaatctgttttctgttcatttataaaaactccttttgctatttataagaattactttacagttattttttctacataatcagacaatattatacactgattttcttgtgatttaaagacgctggtgttatgataaatattgaaaaaatgtcatacagatgcgaggaggaaaaacatggtacagaaagccattgattttgccaccaaggtacatgaaggtcagtatcggaaggggaccgacagaccgtatattgtacatccgatggaagtaggaaagatagtatccacgatgacacaggatgaggagatcatcagtgcagcaatcctgcatgatacgatcgaggactgtgagggtgtggatgcaaatgtgttaaaagagatgttttcagcaagagttgcgggaattgtatcacaggaaagcgaagataaatccaagacctggatggaaagaaaaagtgcaaccatagaaaggcttaagacagcaccaattgaggttcagatgatcggacttgcggacaagctgtcgaatatgcgggatattgatcgggattatcctgtatgtggggaggaattgtggaacagattccgaatgaaagacaaagcaacgatcggatggtattataaaggcgtcagagaagcattacgggaagcatttgcagagacggaagcatttgcagaatactgtagtctgattgacaaaaattttggataataatgaggtagaagagaggaaaatcaaagatgaagaagattttgatgttaggtacaggtgggacgatcgcatcccgtcagacaaaggatggactggcaccgggactgacaccggaggatattttatcttatattccggctgtaaaaaatgtatgtgaggttcagacaaagcaggtgtgtaatcttgacagcacgaatgtaacaccggaacactggaaaatgatggtaaaagcagtggaagacaattatgcatattatgatgggtttgtaatctgccacggcacggatacgcttgcatatacagcggcggcactttcttatatgatacagaattcagccaagccgattgttgttacaggagtttgctaagcctattgaacaatatttatttggtaactagatacatgtatttatgtatctaaaagatattatacgagggagtgggggaatgaactggaaccgggcgatatttttgaaaaggattataagattctggtaaaatagcgcagagggttgcgtttcatggctcagactgatacaatgaaaaaaatacatggaatattaaaggaagaggagaacgtaagatgaactttttggaagaacgtattgtcaaagatggaatcgtgaaagagggaaatgttcttaaggtggacagttttctgaatcatcagatggatattgaattatttgaccagatcggagcggaattcaagaagagatttgcagataagaatatcaacaagatcctgacaatcgaagcttctggtatcgggattgcctgtattgtagctaagcattttcatgtgccggttgtatttgcaaaaaagacacagagcatcaatctggaaggggagatgtatgtagcagaagtcgaatcatttacccacaaatgcaagaaccaggtaattgtagcaaagaaatttctttcagaggaagatcatgtgctcattattgatgatttccttgcgaatggatgtgcgctgcaggggctgattcagttggttacagaggcaggtgcaactgtagagggaattggaattgtgatcgaaaaaggattccagtccggcggaagaatcatccgcaaccttggatatccgctggaatcacttgcgattgtagaagctatggacagtgagacgggtgagatcactttcagagagcagtaaaaagtgcaaaaagacgcatatgcctgaacaaaaattttgtcgggaatatgcgtcttttgcgtatatgatgaactaagtgcagatttgtattttcacagggatctgcactttttgatatacaaaaagagagtgatatttgttttagctggcccacgagcggctatagaaaaacatggaaagtgaagagtcaaagataacaatatatccaatcacgctgagcaggtttagtcgttttgctccatccattcatttaaaagcctgcaatagcggtcggtatcttcaacgaagcatgcatgacggcagtcatcaaaaagttcccagcgtgaattcgggatactgtcatacatggtctttgcaaccagtggagtgcacagatcgttggttccgttgatgataagtgccggttctttgatatttttcagtttgtcacggtactcatagttgctgagatttccgattggcgtgtattcatttggtccccacgcggtgatataagagtctgttccaattttttttggacggcgcaggcattcaggatcggtgtcttttggtacgccggcggcatgaagaagcataaagcgttcattggctgcgagatatgccggatcgtcaaaattgccggttgcttcagctttggcaatggcgtcctgatcttcctgggacatgaatttgatcatacggtgttgttcctgggcccacaatttggaagatgggtgggtgctggaaagaataacggatttgatcccttctggtttgtgatcgcataagtattcgattgagagcattccgccccaggactgtccgagaagatgaagttcattaagtccgagatattttctgagttcgatcagttcattcatccatgttttagaacaccagagttctgaatgtccttctacataagaattaccgcagccgagctggtcgtaggaaataattgcacgaccttcatcagcaagccggtcaagtacttcaaagtaattatgtgtagaaccaggtcctccgtgaagcagaatgagtggttttttattgccggagcattcgcctgcaatacggtagtaggttttgtatccaagataaggcatgtagccttctgtaattttcatatttaatccctcctatcagtatactgagtctcttcattataacatcagaatgaagtaagggaaagaaaaagtggaaaaataaaaaaataaaaaaaacaaaaaaattgttgacaaacagttgaatgatgaatataataataagagtcacgcgggtgtagttcaatggtagaacaccagccttccaagctagatacgtgggttcgattcccatcacccgcttttgttatgttttaaatcaggagcccggtcgccaaagtggtgaccgggctcctgatttatagagaaaaatttagtcatttttgactggtacgttaaaatgtcggctcgattataagggtaaacatttcgttcatcccttgcgtcctgctgccagatatgctatatttaagacacaaagagggaaaccgcaagcggctacccccaattgtatagttgactgttatttatgaacagccgtcactatttgcggtagtggcggctattttcgtttacccttgaaaatctcatgttgccttgtctgctgtcatcatggtaagatacagacagggaaaccaaagccaggcggctaccctctattacggagggataaaaaataccctccagacgaaagaaaggagggcgatacgatggttacatattctgatctgattcagtttagtatattcattgttgcccttgtaggtctttgttatgagattttcaagggtaaaagaaaatagccgccaactactgggaatagttgacgactgacattagtaatagttgacactatttgcgggtagccgcttgcggtttccctctttatgtcttaaatatagcatatctggcagcaggacgcaaggggtgaacgaaatgtttaccagtgttcaagcctatagaaataattaggatctgactatttttcagaatcacgtgctattctttcagctacagcttttttgatatatccgttgactgattcaccggctagttgtgccgcttctgcaataatttctttttgtcctttaggaaatgtaacgtttatccgggagtttatatcggtaagattgtaaggctgttttggcgatttggtacttttttggtacttaccttgatttttcatccccaccatgctatactaacacccgttacaaaacccctaaaaacaaggtcttacaagggtttcgccgattcccggcgtaaggtcatatacttacagtatatgccttccgcggcattcgtcagatgtccatgcaagcatggccgccagactcattgctgcgcgaaaatgaatcgagtgttcgtgaccttccactcgtaaaacaaaactagaggagagaatttcatatgaagaacaagaatgtagcatttatgactcaggcagcgatgatcgctgcaatctacgtggtgcttacttatgtatttgcaccattttcattcggagaagtacagatacgtattgcagaagcacttacgatccttccggtatttacaccggcagcgattcctggacttttcgttggatgtattgttggaaacattctcggaggagcaatcctgccggatatcattttcggaagcattgcaactttgatcggagcattttttacttatcagcttcgtaacaaaaaccgtttccttgcaccgttaccaccgattattgctaacacagtaatcgttccgtttgtacttcgttacggatatggagtagcacttccgattccgtttatgatgttgacagttggtgtcggagaagttgtcggatgtggtgtgcttggattagtcctttatactgcattgaatcgttataaaaatgtaatttttaaaacagcataagaagatgtaaaaagcggacagactgaaaagctattcagcctgtccgttttttatactattgttgtgtatacaatcgtagaattttacaaatttgagtggagatatatttatggaaaagtggataagaatcttctataatataaaaagagaaactgtaaccagatgaaagtttgacagtaagtgaaaaaaggagaaatatgaaatatacagttgttgttgctgatgatgaggaggaaatccgcagaagtcttgttcgcagggtaaagtgggaagagattggttttgaagtggtcggggaagctgaaaatggtgcagacgcgctggaactggttgaaaagctggaaccagatctgctccttaccgatatcaagatgccatttttatcggggattgagctggcacgggcggtcagggaagttcgcccgatggtacagatcgcatttttaagtggatttgatgattttacctatgcgcagcaggcaattcaatataatattgtaagttatatgctgaagccgatttcagcaaaagagatcgaggcggaattgataaagattaaaaaagccatggatcagcgagtggaagaatttacaaaagaaagaaaagagaagctggacatccgcaagacgcaattccttattccgcttttgctcgacagctttcagaatgaacgggtgtccgaagaggcacttcttgagcgggcagaggaatgtgagctgatccgtaatccaaagccggataatatgcagtacgtggtgcttgtaaccggaatccgtgatgcaaatggaaaggatcagacaagctatagcagtgtaaatgcagttgatatgatcttgaaaaaatatgttcattatgtaagctgccatctggaaggaagagtggtatcgctgatcgcgacgactccgggaggtatgggtaagtatttacatattattgtagaagaaattgttcagagtgtggagcgtattatgggatattgctgtcagatcggggtaagcaggagtgtgaatactcttggaaaatgcagagagagctatctggaggcaatgaatgcgctcagttattccagaaaggataaaagcagtgtctatttcatttccgatgcagagcacggatcgggattggaacagggagaaatacaggaaattacagcaacgatggagaattttttacgtggtggaatggcagaggatctggagatttatctggatgatctggaaaagaaactgcgaaatggaggcaagaatacactggtacttagtacgatacttttgaccgagatcggggcggcagtatataaggttatttatatggcaatcggggaatgtggtgtagaagttcttcagaaaaaatattccatgcagcagatgcgtgaaatggaacgtatggcagagaattttcagatcataaaaatgctgtgtatggaggctaaaaaaatgcttatggatcagagaaagaagagcagcgaggtgatctgcgagcaggcagtgcagatcatacaggaccgatatgcccaacaggatctgtctgttatgatcatcagtgaagagatcggggtgtcgccgaattatctcagcagtctgataaaaaagacgacaggcagttcactggttgagatcctgacgaaaaaacgaattgaaaaggcaatggagcttctgcagtgtaccggtatgaagatcggtgagattacagagctgtgtggttataaggatcagtattatttcagccactgcttcaaaaagctgactggagtatcaccgaacaaatacaggagggaacatgaacaggcgtaaaaaagaagcagatcagcacaagggatggaatatatctatttccggtgtgtttattgcaatggtaatgggaatcgtcctgatttcggtagtggctgcaacgcttatttttgttcagatttatcggaatgcaatggagcaaagtgcagtgacaagcagttcccagagctgtgaacaggtacagaatacggttgagaattatacacaggatatgcggatcatactggaagggatcgtggcgagaatgcgtcatgagaataatcattctgaggaatatatccagaatctggtaaatatccgttccgatgtagtagcggtaacaatctgtggtgaagatggggagcttctgcgttactggaacagagggcagaagctgaaagagaattatcgcattgttcagagtaccgaaatggaagatgacgatggcaggctgcgtataaccaaaccatatgtggaatctttgtttgagggatattatccatgggttgtaaccgtttaccagaagattcagaaagaagacggaaccagtatacaggtaaatattgacatccgtttttctgacattgccaattatgttgatgatgtagggatcgggcagcacggctatgcctatattgcggacaaaaaaggcaatctgatctatcatccacagcagcagctcatttattccgggttaaaagaagagaagggaatggatttaaaagaagggacacatattcaggaacaggcgatctatactgtgaaaaatctggagaactgtgactggaaaattgtaggtgtctgctatgtagatgaaatgattacggagaaggtaagcagtgcggtatccagacttctgatcgtcctgtgtctggttatgggagcagtctttcttctcggatgggcattttcagaactgttctcagcaccggtaaggcagcttgctgatgacatgcaccggtttgaaaaaaatgctgaaaattttgtatttgagccgatggcgggaactacagagatcacgactttatccaactcgtttgaacacatggttgtgaagatccagaagctgatggagcaggttagacaggaagaaatcacactgcggaaaacagagctgaaagcgcttcaggcgcagatcaatccacatttcctgtataatacactggatgcgattgcatggatgtgtgaagacgggaaaaatgaagatgcagaagagatggttacggcacttgcaaggctgttccgtatcagtatcagtaaagggcatgagctgattccaatcgaaaaagaagtggaacatgcaaagagttatctgaagattgaaaattatcggtataagaacaaatttacctattcatttgaggtggaggagtcgtgtctttcgtatctttgtaacaaaattactttgcagccaattatcgagaatgcaatttatcatggtgtaaagcagatgatcgatgagggtgagatctggatccgtatttttgaggacggagaagatattattttccaggtggaggataacggaatcggtatgacggaagaacagtgccgggagattctgcgcaaagagccgggagaccgtaccggaatcggaatcaagaatgtaaatgaccggatcaagatttattttggaagcaattatggactgaatatcacaagtgagctggatgaaggaacctgtgtgacgatccgtatgccgaaggtcagggaggaagaatatgagaaaaagtagaagaaaaccatttattgcaattggtgcaggtgtgatcctacttgcaattctgttttttgtcctgacgggtaacggacttttggaaggaaaagaaggcagtacaaatagcgtcatcgagaagaaaaaagtagtgtttctgacaaaatccatggattcttctttctggcagtccgcatatgcgggagcaggtgcggcaagtgcggaatataatctggatctggtgtgcgaaggaccggatggagacggtgaggaagattatgaggcgcagaatgaaatgatagaccgggcaatccgggaacaggtagatgcacttctgttctctgccattgattttgaaaagaatgcggaagcaatcgaccgcgcggcaaaggcaggaatcagaattgtggttgtggacagtccggtaaacagtgaggctgtggaatgctatattggtacagacaattatgaagccggatgtatggcaggagaagaagtgcttggcaatccggcggaaaatctaaatatcggaatcgtaaattttgataagagtacggagaacgggcagcttcgtgaaaagggattccgggatacggttcttaatgatgaccgggcaaatattacggcgtccatcaatgtgaagtctacgatcaccgacgcaagagagggcactgagaggatgttgcttgacaatccgcagatcaatgtgatcgtgacatttaatgaatggacaacccttggagtcggggatgcggtagaagcacttggcgccggagagcggacgcaggttgttgcgtttgacagtaacgtaaaatccattggaatgctggaaaaaggaaatgtagatgcgctgatcgtccagaacccatatgcgatgggatacctggggattgagcagatcaatacactactgaatggtcagaagccggaaaagaaagagacggcaaccagcagtattctggtgacaagagaaaatatgtatgatgataagagccagaaggcgctgttttcatttgaagaaaagtaacgggtgaaatgtttgtagctgctcggaagtatagaagctgtagtctgaaaaatatttggactacagctttttaaagaattgggcatttgaaacatttatggacgaaattaagtaaaaatttatataaacgttgaaattcacaaactcctcgtagtttttcacatgggtgttttattcccttcttgttatactcgtatcatcaagtaaacgttatacaaggaggaacgaaattatgaaaagaagaattgtagcagcgatgctcgcaggtgtgatggcacttggaatgcttgcaggatgcgggggctccggtaagagtgacagtgatggtggaagcagtgataagaaatcatcagacgctaatatcgcagtattctactatacctattctgatacttatatcgcatctgtccgtacagcactcgatgcaaaacttgacgagatgggtgttgaatatcaggactatgatggaaacagcaaccagacaacacagaacgaacagattgatacagcgatccagacaggtgctacagcactgatcgtcaacatcgttacatctggttctgtagatgcttcttctcagatcgttgaaaaagcagaagcagcaggaatcccggttattttctttaaccgtgcgatcgaagatgacaagacagaaggcgatgtacttggaagctatgaaaagtgcgcattcgtaggaacagacgctccggaagcaggacatatgcagggcgaaatgatcggtaactatgtagtagaacattttgatgaaatggatctcaacggagatggaaagatctcttacgcaatgttcatgggacagctcggaaatgcagaagctatttaccgtacacagtttgctgtagaagatgcagataagatcatcacagacgccggcaaaccggcactggaatactttgacgcttctaacagtgacaaatatcaggttgaccaggatggtaactggagtgcaacagcagctaacaactatatgacaaccaacctttcccagtacaacgaaggaagcaataacatgatcgaacttgttatctgcaacaatgacggtatggcagagggtgcagtctcagctctgaatgataagggatacaaccttggaacaggcaaagactgcaagatgatcccggtatttggtgttgatgctacagacgcagcaaaacagctgatcgctgatggcaagatgacagcaactgttaaacaggatgcagatggtatggcagcttgtatcgcagaccttgctaagaatgcagcaggtggaaaagatttgatggatggaacagattcttacaatatttccgaaaaagtaagcaacaagatcttcattccataccaggaatactcaggaaaataaaaatgtaaaaaataaaggtggcggccaggtggttggccagccaccttttctaaagttgtgacgcagccggatggaactgcatagtggcaggttcgaaaggtatgcgagattagaagatgagagacaggaggacagctatgaaacaggatgttttactgcagatgacggatatctgtaaagaatttccgggcgtaaaagcattagatcatgtgtccctgacagttaaagcaggcactgtccatgcactgatgggtgaaaatggagccggaaagtcaacactgatgaaatgccttttcggaatttatgacaaagacagtggcaagattgagctggagggaaaagagattaatttcaagaattcgaaagaagctcttgaaaatggagttgcaatggttcaccaggaactgaaccaggcactcaaaagaaacgtcatggataatctctggctcggacgttacccgaaagtgggcggcgtcatggtaaatgagaaaaaaatctatgacgacacaaaaaaagtatttgaagaattgaaaattgatgtagatccgaaaaggatcatgagtacgatgccggtatcacagagacagatggtagagattgcaaaagcagtatctgtgaatgcaaaagtcatcgtatttgatgagccgacttcttcccttacagagcaggaagtagagcatctgtttgatatcattgagatgctgaaaaagagaggatgcggaatcatttacatttcacataaaatggcagagatcaaaaggatttcagacgaaatcacgatcatgcgtgacggaacctgggtagcaaccgagaaagcagatgatctggagatggatgatatcatccgcctgatggttggacgtgagcttactaatcagttcccgccaaagacaaataaaccgggcgatgtagcgcttgaagtggaacacctttccggaatgtattcgatcctgaatgatgtttccttcaaagcaagaaaaggagaaattcttggaattgccggacttgacggaagtgggcgtacagaaactctggagacaatttttggaattgcaaccaggaaatcaggaacgataaaacttgacggaaaacaagtcagcaataagaatgcacaggattcgatcaagaacggatttgcacttctgacagaagagagaagagcaaccggtatcttcggcatcctgaacattcgtgaaaataccgttatctccagcttaaagagacacaaaaaaggattttatctgagtgaaaaatccatgaaagaagatacgcagaaatatattgatgcgctgcggacaaagacaccgtcgcaggagacaaagatccgtgcactttccggtggaaaccagcagaaggttatccttggaagatggcttcttaccgatccggaagtactgcttctggatgagccgacaagaggaatcgatgtcggtgcaaagtatgagatctatcagctcatcatcgatcttgcgaaccgcggcaaagtagttatcgtagtttcttcagaaatgccggagcttctcggaatctgtgaccgtatcatggttatgtccggtggaagacttgccggagagattgacgcagaagaggcgacacaggaactgatcatgacttacgcagcaaagtatgtgtaattttcaaacaaaaagaaggaggcttcccagatgaaagcatttgcaaatataaaatcacgctatgcagaatacaaagcactggattccgcagacaaggtaaaagcgtggaaagaaggacttatcaataatgcgatttatcttctgatcattatcgcagttatttacacttacacacagaacagcagattcctgagcgtggcatctattgttaacattatctcgctgtctgcagcgaacattccgatcgcgtgtggtattgcaggaacgatcgtacttaccggtacagacctttcagccggacgtgttgtaggtcttacagcatgtatttctgcatcacttttgcagtcagtaacttatgcaaccaaaattttcccggatcttccggttcttccgataccactggttattctgatcgtaatcgtagtcggaggtattgttggatgggtaaatggattcttcgtagcgaaattccacttacatccattcattgtaacactggcaacacagctgattgtatacggaattcttctgatgtacattatgctgaatggtaacaacggacagccactttccggactggacaaatcctttaagaattttgtaacaggaagtttcttaaagatccgtggcgttccgataccgaactatgtatggtacgcttgtgtcgtagttgtattcatgtggttcatgtggaataagacaacatttggaaagaatatgttcgcagttggttccaacccggaagctgccaatgtatctggtgtaaatgttatgagaacaaccattctggtacatacacttgcaggatgcatgtatggtatcactggattcattgaatctgcacgtatcggttccaaccaagcaaatacaggtctgaactacgagtgtgatgcgattgctgcctgtgtaatcggtggtgtatcttttgtaggtggtaccggtaagatcagcggcgttgttttaggggtgttcattctgagaatcatcttcgttgcactgcagttcctggcagtaagtcagaatatgcagtatgtgatcaaaggtctgattattctgatcgcatgtgcaattgatatgagaaaatatctggtaagaaaataaaaagaaaaggctgggaaatgttatggacgagaataagatgccggagaatgacggatggaagaaaaatgcaagactggcgatttatgcaatggctgggttttatctgctgacactggcataccagatgttcagggcgatttccacaagtcatggtaatgaacagcttgttatgatcgtggcgacgattctgtttctgatagttggtgttggactgatcggatttggactgatcgcaggataccgcaatataaaagcagatcacagagaagacgaaaagtagaaatcataaatattacctcacaagagaaaagggcgtgtgaaaaaacgaaagttttttcatgcgtcctttttcttataaatacaacagtaattatatttcacaaactgtcacaacatattcatgttccttttgaataggaaactgaactataccttcttttatatgttgtgaataaaataaaggtatcgccccctcttctgcatcatctcgtaaaatatctcggtttctgaaatcaacagtcaaccctgttttcatttttaatcctatatccggaagcgttttatcccactgatgcaactttttcaatactgaaacttcttcttcatttgtaaccaaatatacatacaattcttttcccgaaacaacaagattatatggaactaccaatgtggtacactggtcaaaatccttatttgtatgcgtagatgtaatagtaacattatctggctgcacctttgtctttttaacttttactataatagtttcctgtaaaacattttctttatcgaatactttatttctgctaccaaacaaatgtatatgaatgagctttccttctgacagaaaatattctctgaatctcttaaaataagctcctgatgtccatgaccttggaattatataaaccatttccccatcatcttttaaattaaataatcccattgatgcaaaaatgaaatacatattaggggctccataacaaactgacggcattgctgtcgcttccggagcatcctttgatattttcatatacgggggatttccaatcactatgtcatatttttccggattccaatttccacctaacatatgattaaaatcgagatactgactggttatataattctcagttataatttttatatttatttttttacttgagcattcccgcatataaagaagattttcctgtaataatggtaatacattctcatcgttctcataacaggttacaataatctctttaatatcctctattttatctaagcgttcgatcatggcacatgttaaaattccagatcctgcaccagcatctagcaacgtaactgtagtctgttgcggtataataaacaatccagccatatatctagctgtttcaatgctcgtaaagaactgtccgtatttttttcgctcttttttgggcatttcttcaatatattgattagttttctctacaatttgttctaacatcaacttccacctatctattttatttctaaacaaaagctacgtcttcacgcctttgaacttttttcctttttctcatgttacgataataacgatttctcgccaacaagtttaaatcatctttatatttttctacaaatctataaatttctggaaatatatcaggttctatttgtctggcagaaataagtaaccctcttagcttttcaatctcaattatatccttattcttcaagcaggttttatacattccaataatctcatatcttttttgatttggaacaagcaattttcctttttttattcccactcctgtcactttcttaaacgcgttgttttgatagtaatgatcttttttcgcctttgcatgtaaacaataactattcaaaagttcttcaacatcttttctcaattgttttgatataccaatattcgatgaaaaagtcatatcatctacatacaacgtaaactcacatttatattttcgtgcaatttcatatatattttcaaacatatcactataagaccagtataccacaagttggctcgttggacttcctgtaggtaacgttcctccacacataactagatctgtcataatccaagcgatatcatctgccattaaaaacttttctttaaacatactgtacacatattttctttttgccgaatcataaaattgtgaaatatccattgttttcacattataatttctacaatgatttctggcatttgaaatataactatgtttcttttttccagatattacccactcaggtgtttctatcctactcattaatttacaaattcttttttgaatactttttaattctttttccgggaccgtgaaatttcgagttcccgtaccattaggttttggttccgaaaaatgattatatttgtatgtatgattttgcttaaaatatttttcatccagcttcagtactctggccaactttcttctgtttctcattctatataatggactaaattctatagagtatgttttactcatcttcaaattcccctaccttttccaatattttaagcaatttcattccggcacgagcaattctttgttttttatcattttttatttcttcaccttctaaagattctgcaaatagcattaatgttgatttcttcatttcaaacactttcgcatatttgtctaaaacctccatcgtaggctgttttttcccattttccaattctgacacatagctctgtgataattccagtttttttgctaattctgctgatttatatccattaaatattcttaataatcttaatgcttcacccattgtatcctcttccatttctgtaaataaaaaaatagattagttagtattaagagtagttatctaataaatattcgataactgttttgcatacatagataacaaacttaccagccaatctagcaattgtacttttatgtttcttacaaaatgcaacaacattctcaataccggatttgaaaaacgctttaacttttctgcaaaacatatcttttgcctcctttctcatctttgtaaacaaagacgccatccaagaaaggaattatgaataaggtagtttttcaaatcactgactaatctatcattaaagcgtgttccatccacacgcttaagacgtagcaacctcgtatcacagtaacacatttacttggcatcacagtagatcatctactcttcctagaccattacgacattgcccgggtttaatttaaggtcgtccaaccttccaagcatttctgctcacattacatcttctggatggatataccttcgttaaagtagtttcattatacccaacttctcattttatgtcaagatattttatcgctattagcgatatttcgtatttatttatatagaaattccttctctgccatttcttccgcaacattcttaatattgttcatcctccgcacccattccatctgatcctgcatcttcagttcttctgtcacgccccactgttcagccatctgttccaccagcatctcgactttttctcttgcttctttatcgacctgattcagatgttccgtcagtttcccagtcagtaccagatactgataccgggcattcctgtgttccttcaaaaactgctttcgcattattccatatttcccatatgtaggttcttcctcattgatttccagatccggcagataataatctccatgcaatgtgtagttcaacccgttcttttcatcataaatctgttttttcatattcttataactccattcctttgtattttgttttgttcttctttatctgtgcattgtgttcttcacttcgttctttcgcccattgtatgcggtcacttatttttttcggcatttgctctttctgttttttcacttcaagttccgtctgcattcggatatcgtctcgcaccagtcgttctaccatatctttccccaacatacgtaaaagtcggttatatctgtccgcaagtccctgtagtatttctttctcaccagataatttctgataatccttcttaacttctgccagttccttttttgtgttctcatgctcctgctttttcttctgaaacttacttttccagttatctctttctctggtaagttctttcacctgtgcagccatcgcacctattttatttttcatttcaatgaataacggtttgattttcttatcccggtaagttaccgcacgttctaacgtagtagcttccggtagaaatgttttgatcattccatattcttttatttccttactgacattatccatcactggttgcaggaattctcttctgtcctccagttttttcaattccgtttctgctttctccgcacgttttcccgctatctctttatctttctggaactgaattttttcttcttccagtagcttgatatctgcccttgcttctgcaatctgagaagtcaatccttcattctccactgtcagattttctttttcctgttccaattcctgcacttcctttttgcgttcttttttcttgaaattgtaaacatccagatgttcttcatgtgtgcctttctgttcccattcaattccatgctgttttgcgatttcagccagcacttccttttcatgatttatccactgattcagttctgtatcatgcttatttccaccttgaaatccaagacttttcaatgcctgcttcagtgaaactctggtatccattccttttcccttccagttggtcacataaggaacaaagtcaatatgcagatgcggagtagcttcgtcctgatgcagatagcagctaaatacccgaagtgtcggattccgtttctggaagtctttcacatattcatccagtacctttacagccatatttccttctaacgttcccactgccatatcctcacgattaccaatctggaatattacttcatggaacagcttctcctgtttgccctgtcggattttttcataataatttgcaatctgccggtcctttcttttcccgacattgtatctctccacagcatcgtcaaacagttccttataaacttctttcagattctcattcttataacaaatgttcaattgcactctgtccggatctacattttctgctacaaaatcccgtctgttatgagccagtgaaccggctccgatcatgccactgattgtccgtttcatcatatattttctcacctcttctctgtttgagtgccagatatggcacataatttttatttacgccagacatggcgatgtttaagaaactgtcgctggacacggcggttttgttacttttgtcaaaagtaacgcaaaagcactttcgacagccgtaccgtccatcaaaagtccccttgcgccctgccgggggcataacgtccggtggacgtctgttccgcacagaccaaagcggatcatagacctgtttattccggtatcctcgcctgcacatattccagatctccacaataaggtgtccccaccagataccattctcttgccagattcatctccattctggtctgtacccattcatcatctaccagcacttccagtccttctccatagtgaaatcctgtatcaatccataagtctgatgataataatccatatcttccattactgctgttatatcctaatcttccctgtttcatcatttcctgctcctttccagtctgtaaacggaatttgtaaacggggctcaaaagattttaaaagttaactttttaagtttttccttcaagttccgtttacatcgtttacaataatctttactcaaacggtatctccaactgttccggtacttccatgaatccgtctttgtcttttttctcaataccttctattcgtttccatgaccgctggatgccatattcctttccaaaacggtgagtaccgtgttgtttccatccttctattgcattattcataatatttgcgatttctttgctttcccattgtttcatctcacctgtccgatgcagtgcatcatcaaacaaaagctttgtacatacataatcgtcttcatagtcatcaagaaacgcctggataattcctgcatttgtatcttccggcataaattctttctgcagtttcttcgcttcttcctcaatctcttttgtaaaactgaggtatacatttccctgttgataaagcaccatagcctctgcccatgcctgtacaatataagctctgctctcttcttcattgtctagaatatgaacttttgcttttgttatatctgtcataactggggcaaatctcctgtttccggttctatccaatggaagaaaatttaggtcattcgatgttccacaaaatacacactgtcgtggtctgtcctctggataaacctcataaggaactttgtaagtttctttctgtctgcttagaaacgattttatctgttcaatgttctttgcagtaacagttgctttcatttctcccatctctataatccaatggttctgtaatttccgataaatattttcatcatccaggtgatccagattgtcactgaaccaatcgtcatttattgccagatatttaaaaaatgtagattttccggctccctgacttcctaccaggcaaagcataatatcatactttattcctggttcatatatcctggatattgctgccagcatatgcattttcatcacgccagtcgtataactgttcttttcagctccaagaaaccgtggaagtaaattctcaatacgtggaacgccatcccacattaggctctccagataatctcgaatcggatgatacttattttcattggaaacaatatctactcctttttttattactcgttcactagtaatctcataattatcttccagatacatctttagattactatcgtccgtatctgtcactgtgaggctctcgcttctccgttcccacggcacctctttcacaatgtccattcttccagaaagttcatttcgtttaatcgcttttttcaataccggatcattttgaagtacggttacacaatttctgattgtctgctttgttcttcctttatccgtatgctccagcatttcattaacatcttctactgtaagcatctcctcattcacaatatcttctaattccatcaaggacttctcgctgatattcgttaattctttcttcaattttttcaacctcccttctctttatcttgaaaaactctacaatttcttctcccgttccaaacatcagcacgtccagatagtcatttatctttctttcatttgccaatgcctccgtaaataattcgtgccactcttcttccggttctggtttgtaaaactctttccagaattgaatccatttcagatatctaatcagcacgtctgttgcatgtttcaaccactgctccagtttttctctgatcatcacaactttaggtttctttgatatcaaaatattcctgctttggtgcgtccttttgtatttgtttctgtcttcgacttttatatccagtccaaaatcttctaccagcttttttgcggcttcatactgtgatattccaaataactttgctgtaaaatctattgcatcaccgcccactccacatgcaaagcaatgatacattttatctgccttcatacttgggtgtcggtctttatgaaacggacaacacgccattccatttctttttactttaatcccgtaatgctccgcagcctgtctcgctgtcacacattcttttacctgttcaaataatgtcacttctacctcctgcccatccgggcaagtctctgatgaacagatattcgggaattgttgtatctttcaattcgtgatatacttaatctgccaagatggtatatcagtgaatctgattatcagagaacttgctcagatattttgtctgggctttttctttttgtctgtcagtagtcatagcttttgctccttacacaaatctccttgtaggaataatgataatttcaaatttgcttccgtcctctaattcaagaagaatcacataatctgaatctcgatctggtaaaatggaacttatcttcaacttcttactgtagttaattgcatcaaatatttttccgactactttctttgttttcatttacttcttcctccgtattaacgtttgttgtccagcatctcagctacttttttctgctgtgacgggtacagatgcccataagtgttcaatgtcatctgaatgtctttgtgccccagcctttccttgataatcagtggttctactccctgatggattaaatatgccacatgactgtgccggatatcatgcactctgattggttttacaccagtcaatgtttcatatttcttgagacgtttctgcagtgttctcgctacaatcggaaacaacctctgatcttccggaaatccataatgttttttcgcatacttctgcacctcttccttaagaaaattcggaatatcaatggtacggactgaattctctgtttttggagtatcgatcacatctcttttcctgatccggttataagtcttattgatatgcaggagattaccactcatatcaaagtccgaaagattcaatgccagaagctctccttccctgattcctgtccagaacagaatttcaaatatcagataatcctcactccccggctcaaccccggcgataaatctgtcatattctgctttcgtccagaattccagcttatttgcatccgatttccccatcttttttactttcttacatggattttccttcagattgtaaattttctgtgcatgattaaacagtgcatttaactgattctggatcatacgctcataagtcttgctgtatcctttttcctgaatggcattctgccactggataatctctgccggtgtaatttcattcatttttcttgttccaaaatacggaacaatctgtttgttcatcatgtgctgcttattacggattgaattttctttcagttcattctttttatcttcaaaataaactgaaataaaactgttcatctccattttcatatccgccgcagtctttcttatgaattccttttcataattcaatgcttctttctttgtcttgaaccctcttttcaacttctgcgttttctttcctgtccagtcaatataacggaagctcacataccaggttccctgtgttttgtctttgtaagctgacatcttaaaccctccttcatactgctctctgagagcatccataaaattttgtttcccagtagggacgtggaatctttccacgaactgccacatatccttcctttgccagttcatcattgagctgctttagaatagaatatgctttactgcgtttcacgcctaattcttccatgacatcatcaacagtcatcatataattagttctcatagtgtcctcctttccagtcacttttgtgactcttttgttgttttcttataataattcacttttgtgaatttgtcaataaacatttgcgaatttatttttttccattccatacatatttcttgcgtatcagcaatttgttaaatctcactcttttgtatcattcacttttgtgctagaatagaagcacaaatattattaaggaggcagcacattatggtaggtaagaaaatccgggcattccgggaattcagaggatacagtcagatacaattagccgagctgtccggcattaacgtaggtacgatcagaaaatatgaactgggaatccggaatccaaaaccagatcagttagaaaagatagcaactgcactgggattaaatgtaagtgtttttctggattttaatattgaaacagtcggagatgtactctctctgttgttttctattgatgattcagtgaacctctcacttgcagaaacacctgatcagaaggtttcactgacgttcgataatcctacaatgcaggactttttcaggaaatggtgtcaatttaaaaatgtctatgaaaaggaaaaagctgaaatattagctattgaagatgaagataaaagacagacagaactggataagctgaacgctacccaggaagaatggaaactacgtgctatgggaactacgataggttgtcataccatcgttaagaagggcgctgaaggcaatgacatcaagacatatgatcttacttaatccacagtcatatctttgatttgtggataaatctactttatctgttatcatatttacgaaaattataaattttgttatcattctgttatcacaaacggttgtcaggactctctcccggcaaccgtttttctatactgttcgttattcttttctgctcttttatatatttccaggcaacagaaaaacccgtagaaccgaagttctacgggtttcttacgtttggacacaacgttatcttacgataacaaatctatattcagattgtattactcgatgattgtagcaacacgtcctgatcctacagtacgtccaccttcacgatactttaatcccgttttacttcttattttttatggttttctctccaaaatatagtgaaaaacggctgatctgcaccatatatttttatttgcctgatttcttggcaccgttttggcaccggaagccctggtcgaaaagattctcttccacggctaacagatgctactctaccaactttatattgcaccggtaatttttaactgttataatcgaaacatgggtgctaccataacggtaggcggttagtccttctccagagggactgtgaccctctgattacatagaaacctgtaaaggaatccagtggaaaggagggctaagccaatgagtattattgacttcatagcagtagtgagcttcggcttaacctgctttagtatcggatatacattaggcaaagataatcataaaccacaaaaataaccgccctggtctggtaaactaagcggttatctttgatgatattctaaatagtaaaacggactaaccgtctatcggtagcactctttttctataatcatattagcacgcatctgtggaaatgtcaaaaaatttcttctttctcaactatatctatttccatacatttttacaacctatttcaagtgttcctcaaaaattgattcgagttccttattccctctcaagaattcatactctttcttattttcaatttccgaatataattcacgaacaaaattttttccaactcctgaaaaggcttttccctgtgcagtatcttcataccggtaatacaaaggggattgtgtcatattccaaggcttctgtgattcacttaataattgcttaattaactgaacacatttttctacatcttttcgatatccagcaatcagcagatatggcactgtgttgccgtaattccatagtccaaacaacgatatcatgtgatctgtaatctcagcaattctctctgctttatcatgatttcctgtttcttcttccatttcaattaacttatacaagtagctttgaatattgacaactgcctgtagcagtttcccctccaggaataacgcagcagtgtctgttccttcctgatgtgctaatacacttgttttcataatcgttgcatcaattacagtatcaggaatttttttcaaaagggcatttgcttcttcatatttctccatttggacatattttgttgcaagtataaaaacgcttgaatttctcactctttcatcctgactatctgctgttcgttccagccactcaataatagctgtattatattccattcgttcttcgtcattaagatctgacaaagtcaaagatccgttcagaacggttgcgatcgtatatattaataagtcgcaatgaggatactcctgtattttacgagatgccatctcgaaagcctctgtaaagctgtccaatgaaacttccgaaagttcattcacaaattgtccaatctctttttctgtcaattcttcatgaaacgaaaacaattcattcatatcaattttcaatagtcgtgccaaagctggaagtaatgagatatcgggatatgtatttcccttttcccatttatttaccgctggagtagaaacacccagataatttgccacctgttcttgtgttaatcccgcagtttttcgatagttttttatctgctcaccaatacgcattgttcacacctcctgtccttatttccattatagcgttcccaatacatgtttacaattgagcctttgtttacttattactttctttttttaactttcaattaattttctctaatatttatatcatcagcaacaaactgcccacaagtttatgaacgggctactaaccctcaaacgacagtgtattacattgcatcaactaaaccaaccttgttatcctgaatcaccactccttcatcttcgcttcatgcctatttttcataatttgcaactggtatataatgacagggattagaaaaatcacagcaactatgcctaaaataacagaccgatttacagtagcaaatgccgcgagcataagcattaataaaagccagggatttcgcaaattactgtaataatttgccctatcttcataggacgtatgaaggtcaaaaggttttccatcattttctttttctacaatcagcaattccctgttaaatgttgtagtgtttgttgcaacacgaccgccaatttcagcccacggacgccagcgaactttaccaacagaataattaagattgatatttttatagaatacggaatatcccatttcttccaagaaatcatggtaatcttcagcattagcttttgatttttgtcctataaactccacgcaatattgaacttgacctggcttacatttttcaaattcatagagtaattttcccgttcgaataaggcgataacctttttcagccatcttattcagccagtttttctgtaccgttaatagcccaccaaaaaaacgataacactttttgctcatagtgtacctcctacaattccgcttgcaatacctacaagttcacgaagtctgataagttctttttcagctatctcctttccttttacagtgataagatactctttttttctaccttcactatctccgaaaagctcaatccatcccttttccagcatttccataatttttctttcgtatctccgttccgatatcaattccattctcatgttccagacaaatatcaaggaataacatatcgtaggattcttcttccagcctgttaagaagctgctccgcagaatagtatatttctatagatatctgacagtcattcgctttcccataatggagcagcttctgttctaaccaattacataggatgatgtcatcatcacagattgcaagttctagcatattttcttaccctcagtctttcgtaacacgacaaatggggaaaagaatccccttcaattcttttcccgaatggacatcactaattttgtgtcatttttccgatgcaacagcaccacttcctttgctgtcttattttgtcctctatataataaacacttgaacaagaaaaaactgtcgccattttataatttatttatattttttatgttttatttatattttatccaaatattacagcgataactaataatgtcaccccctgcattattctttttatttttagcgtcatttgataaaacatcaacgtttttgatggcaaaaagggaacctgcaaaaccagattccctttaaaatacatgctcttctctaaaaggatgataaatccaccatcctctgcttatttttaaaaactttttccttttttacaatacttataaatattaaatggtttttcttttttttcaaataaaatccctgttgttttaataatttttataagttcatccgactccatatctgtcgttttaaatataaatattttcttttcatttgttatgaaaaaaaagaagtttttatataagaacattctatcaatatttttaaattcataaatttgatcttcatctattttaattgcgttttcatcgatatccaccgtttcatatcctgatctaccccagacaaattcatgaacatttttttcaaaatttttaccaatcatttgataccaaataatccaagccacacaagccacacaagttccaatccctattccaaacatcaaataactttccgacagataacaattaatcgacagtaaaaattctacaggtgtaaaaatatagataatcattctacttttctgtcttgttttaaataattgattaggaattataaacccaagcgaaagcattctttctaattcttccctatcctcatctgacacaattgatttaatatgcattcttcttaatcccccttttgccagaggtcctctttataaaatcgaacctctggccattgtctcttttattcttttacaatttacagcgcttgaatcaacaaaccaaaaacagtacctgctccagctgaaaataaagcaataattgacggaattgcatttacaactaatgcacccgcaagaactaatattacggctcctgccagtatattactatgctcttttgtgaattctacaacattaaattcaagaccactattagaatttaatgtcattgtaaaaatcaaagcaaccgatattgtccactctttttcctcttctggcagcaaatctgatgtactaaatacaatggaaaactctacactattggcaaaaacattatttatttcaaaagcaatattaccagatttaaccgataaagcaattttttctatcgtatttccaaagttatctgctccctctatacctgtatctgataaatttgatgaaatctccataatttgatttttgcaagtttgtgtcaattctccatcatttcctatatccacttttatattataaattttaccagttgaactttcaagcgatgtggatattttagtagaaatatcaattgctccttgaggactcatcattgttcccagtgaaatttccttatcatactccacacccacatccataattttattcagataaccaagcggctccattacattatagacatattgatttcgtgctatttttacctttgcccgaagattttcttgcgctatttcctcatctgtttttgtcgatacggcatcgaactttttaaatccagtatctctccctgaatatgcatctttatccagtgggaacgaaggtgatgaagaaaatgagttcaactcacaaaattgatcaaatgcccagttcttcggcatcgaatatcccaaattacagctaaatccagttgacatatctgccacaaatgatttacttgccaatcctgcttcataaactttagtacatacatatcttggtgcataaatgccgactttataatttttatcatttgtcgaactgaaaaagatcatgtgaatctgttcaaaataaggtataataaatgtatcaatctgatatgaataacaatcaaaatccactgcaaagtatatagtcgttccacttggtataccgattctctcggctgctaaaattgctgtctgtgcatcaacacttccctgggacggatccttaaaatagtttaattcatatcctccatcctgatatatcgggaataccgataatcctgcattttcaatgtttttcacttctgttgatgtcaaatatttcggtgtatgttcttttccaacagaacctgtcagataacgtcctacatgagtataccctgcattttttatatctaatgcctgttgtttatttaatactgttgcacagtcacacgcttttgctgccctgtttgtatcgcctttactcgtaagcaatgatttcatagtagaaacatttacttttccttttgttacaagtccaattcctgtcagaccataaaactcctgaaattctgacacctttgactctgtagtcgaatcaaacacgccatcgaatcttcccggattatatccgttaaaatatagtccgtattgagcaatcttattaaatggaacatatttcgtcgagttctgtccgttctgtaatgtacccggaaacgcatttgttgttgcatcgccaaaattaactgaattcaaatctgtaattaattcagttgtaactccttcagccgcctgcaatgcaccaactaaagacaaaattgtctgtcttgaggcaattccatcacaaggtccaacaccaataacatctgaccagtcactatttaattgctgttgaataagaacaatattggaatccccaccagaaacctttgtaaaccagtttagggataacaatccagaccaaactttccaatcaattttgcccgtaacttccagtcctgcattttcctgcatctttttaactgcatttactcctgatgtataataaattccagtaattcctccagcagcatatcctttgcaaaacagagcacactgaatcaagcatacattaacctgcggagtatcattcggatccatttttgtaataatggctaacttcttcatggtattaatagtaagtggtccaaccgttcctgtaatcgttgagattccattctgaatctgaaatgcacgaatgattccctgcatcacggctgttccggtctttccatcttcatccagttttacccaatccttatgtccaccaaacatcgcatttaaatatttttgtgctgcttttacattctgatcactcatattcactacctcctaattcaagtcaattataaagatttctaactctttatatgtctatcactaaaagttacaataacaatttatcaatcaactgtgcctattttgtgactattttccaaagaattcattaactcccttataaaatccttaacaaattatgaaagaaaccatcaatttatcaccccatatcccattatagaactgtaatctactgcataatttctctgccgtacctgatcactggaatttccctcaatcgtgtaaactcttccaccttcacacttttctactattcctacatgatccgatgttccatcatgatcccagtcaaaaaagatgatcattccagctgtcggagttgttccgccactctgccacttattctttccctgaaaccaggacactccatcactgcacaatgagaatttaggaacattcccacttgcaatcagaccgctctgatccgcacaccagcttacaaaacaggcacaccattctacccgactgtcaaatccgtaccagctccagaacttctgaccgccactgtttccaagctgccccattgcatccgacacaatctgctgattaccaaacaaaccagcaaacaggctgccaccggaataataccgcatcacatggggaacgtattggggatctccgtaactgctccatccatgcgaagctgcctgttcctgtgaaaactgcaatgcattggcttctgtataaccgcctctttgcaatgcccatcctatgtagccatttccatagttatatccctgccatgcaagtttcagcttgtccagatcctgtggactgctgcatcctgcctgtctgatacagtctgcaaaggtctgtactccaacctctatcgaataatccggatcagtaatagaaccaggagtgtgtgggaatcttgtattatatggactttccgaacactgcatcgggtctgttcccctgcctccagattcctgcatcatgatggcctgtatcgcagacacatattccggaatgccgtattgggatgcatactgctgtatcacagaagtatacgcaagcacttcttcacttagggattcggagctttccgaattactgctgaaagctgctcctgcaatgattcccacaatcagaataaataccagaagaaatgcactacctccggcagcaatccattttcccattttttcaagagctactacccctttttgaatcgctgctgtaattccctgtacggataactttgaaccctttccagttacctgaaggactgcttttccactttctgccgatgcctgtgctgactttcttgccatctgggctgctcttgctttctgcatcgcctgaagacttttttccatctgctgtttctgcatggatgcctgtgtctttattttttcttgagacagaccggatacttttaccactctcggtgctgctttcacctgccgtttaccattctccttggcaagtgctgcctgctccggtttcaacttgattaatttctttccgctttctgccccctgctccattgcttcttcggcagctttcgcttcttcctgtctgctttttctttcctttatcttcctgtaggtcactccagcaagtttttttccaccttgatatgtggttttccctatactttttcctgccacactcgccgctctgtactgtacggattctattttttcagttccatactgtgttggggattctgactgcccactgcttttttcatgtagttcccttggcttttcttttgcttccagaaccgctgagcgaaccagttctttcggaagtcgggcagccggatttcgaatcttcggattcttatcccttacccgttccttgatatctttcatccggtcaccctctttccgtatctcttatctcatcgggcaacatcccgatgtttctttttttcctgctgtttctgcaactgctccacctgtctgattgcctcatttaccagtggatgttcgttgtaatatggcacaagttccaagtctcccctgtcttttgatgacaacggtaatggatattccatgtctgaataaattgattctggatcatgaatagaaaactcaatagccggacacatattggcagatgttctacaatatttctggtactttttatatgcctcttccagcgttctgcattttgtatattctcctaaatcatggaactcaccgcactctgcagcataaaaagttatcgttacttcttcttttttcttcattatgattctcccggttttgttgtcattagtttataaaggtctgtattctttgggaacgtattctcaaatggtacgatattcccagagcaacggattaggccactgccaaccgatacatttgtaatataggacagttggttttcggaaatattcaaaagagctgccaattcttccctgtctgtacttgcctgattcaaaagaatcaaaaactcactgtttgccaacatcagtcttgcagtgtccgatttcagaagttcctcaacattttgggttaaacctgtcacgaatccattgtattttctgattctcttgtacagtcggtagaagaaatttgcactgtattcatagcggaataacagatagaactcatcggcaaatatccatgtcgtttttccttctttccagttctgaattaccctgttgaaaatactgtctaaggtaaccagcattcccagtggcataagctgttcccccagttcccggatatcataatccatgatcctgttcttcttattcacattggtcggctgtgcaaaggtgttcaggcttccattgataaaaagttcggatgacagtgcaagtccccttgcctcttcttccggctgtaacatcaactgtcggtacatatctttcaatgtcggaacttctccggtataaccacttcggatataatcccggtacacatctgcagcacagcggtccagaatcgacttttcttttgccgacagatttcctgctccaaccaactgctcgaacacagacaggataaactccgatttttcaatcagtggattcttttcattgccgtaggctgcgtccatatccattgcattcagatgattgtctgatgtcgcagatacttttacaacctgtccgcccagagcctctactaattttgtaaattcggactccggatcaagaatcaggatatcgtcatcggtactcaatgccagatgcacaatctcttcttttgccgaaaagctctttcctgatccactgacgcccaaccggaaactgtttccattcatcagtttcttccggtcggctaccagaaggttcttgctgactgcattctgcccataatagatacctcccggctgcaggatttcctgtgtatggaacgggattaaaacagccgttgattccgttgtcaatgtacgcagggcattgatctttcgcagtccgtaaggaagcactgtattgagtccgtccacttgctgccactttaatgttgccatctgacacagatgctttcttgcgattgacagaatcagttccgtatcggaatccagttgctttttgctgtctgccagatgtaccattgtcaaaatcccgaacatcatacgctggtctctggttgtcagatcatcgagcatttccttggtttcttttctctgaagttccatatcgtatggtacgattgccgagaagttattattagcgttctgccttctctgccagttggtcacgttagtttccacaccaagcagtcggttctggatttcccttaccgcttcatccgtagggactggcaggatgtcaatcgacaacatcagattccggctaaagtcacacaattctgaaatcatgtcatctttgacataacttgcataatcctgcatatacaggactcttccgtatctgtcaccgattttaaaatggtcacgttcaaattccatagaatccggacacatccagtccttgaaacttgttcccttcttggcaaattgtttcagatcaaacggaaatgcctgtgggacatctcccttgaagaaatccctgaaaatctggagccggctctctgcgtccagtccttctgctgtggacgataactttgccagatgtgttacgatgtctgttccgatacgtgcaaaataggttcttgcatcatcaatcgatcttttatgtacactgacggtcagataccgttcctgatagatgctgttgtttgttcctgtaatcttagacaggagcatttcgttgtattcttcccgatagtggtccagtccatcttccttcattggaagcagaatagacttttcgaattcttctttattgattctccgattattgatggtaatttgggcagaaatgccggaatccagtgaatttaagagttcagaataatccagaaacatttctgtcttattgtccttactcgcaatataatagttgatatctgtaaaacgatatgtttttgagaatttcgttccctgttgaaaaattccatccggccagattcgctggatgggaattgcctgttggacggatttcggaactttgaagcgttccttatccatccgaagtgcctgacttaaggttttaatcaaaggcatcactccttcccttgcgtttctttctctgttttgcttctgctttttgctcccgctcttttatgatttccgctccatccttttgattcttttctcccagcgagatggtctcctgcatgcaggagtagtagatatcttccgactgaaacaccagtttcttcggatacagcaattcggatttgatcactgcccataaaaactgttcggctgtcataccatgatatttgaaaaagccacaggcagcaaatggagcagcaccaagcacacacagccatccggttatttcctgtccggtaatatcacgcattccaaagtaaattccgattgctgtaagaatcgcaagaacagaacacacacattgtctcaggtccagtcccataaacatggattcttgatagtccctgatttctttgttcatctttacttccataaattatcgttcctctcccctgttttgtttcttcgttttctgtggtttttctttcggtacttctatcccggcaaatctacagtgttccgcaacgccttccggatcaaattccgcaagtcttgcaaggtcaaacgctaccttctgataggttgcatatcctgatcttcctgtttcattcaacacttttccaagtttatgttccttgataaaatgaagcatatccttggtaaaatctcctgttataaaagcctcatttggctctaagaactgatagggcagattaatggttacatctccaaaatcttcccagtctctcccttccttatggcagagtcctacatataaattcccattgttccgataagagctcactcgtatcgctactgtctcacgtccgaattcccagttatatcttaatgttttctttgtatccatattttttaacctccaagtcccatcatttctctgacaatacggtcagatgccttaattgctccaacaagtaccaataaattgaataccagttctcctacatagttccacacgattgtaactgcactcagctccgtatctcccactgccggaggacttgccgcataagcagaaaagataatacacgccagtgcaataattgccccttccagacacacgcctatataagaacggataaagttctttccaatagactgcgtgggttctcctgcaaacgaggaaatcggaatcggggcgattgccgtatacatatagattttgaacattctgccatacactgtcaggatcatcacaaatgacaatacggtgatcagcagactgccaagcagtgtgacaatccacaatggaatggattccagcattcccacactctcgatcttatctacaatctccgttggcagttccgtcacgcttcctgccatactggagccactcattacggttgtcacgattccttgcacaatggaaaacagtgcctgcataagttccattccatacgtgattgctccctgagcaagtgcaaaccggataaatgcttttagcacatgttccggctttttcagatctgtaaaactgccacacgttttaatgattccggctgcaaaaaacaacaccagtaatccataggcaatagctgtcagtgcatcattgatattggtcataatccgccagatgccgccgcctttaaaagttgccggattttcagtaagcagtgtccacagttctgccatcttttcactccatgtagacaacgcagagttcagattctgtacaatccagttatcgctcaaaaactttcacctccctgaacatacttttgaatgcaggagtaccttccggcactcctgctgtttcctgatatactttttcaaagaggcttacgccataatcagatccaggatttctttggcgaacgtaataattactcctccggccagtgtcagaaatccatttgccctctggcttggatcatggctttttaaagacagaccaacctgcacaacaccaaatccaagcaaaatcaaaccgattgcacgaatcagggaaaaaataaaagtagacaggttattgataacggacaacggatcaccggctgcgaatgcggtcgttgctccaaccgttacggtcagtaccagtgccatgtaaaggctcatccactttttctgttttctccccatcggcatcggggttgtcattttttcagttgtattcttttttgttctattcttttctcctgtgagaaatttcttcaatacacatcactccaatccatcaaaaaactgctattcaccaaggatgtcttcggtagacagcagttcgtagtcgtctaatctgttaatgtcaatctttaggtcgtcgtgagccagtggtgttttcgcataatcataaggcgatgcaccaccgtcctctgtgtatctgaaattcacatgcttttttaaatcatatttatcgtccatgatcggacgctccccacgaataaacaaaatcgctttgcggttatctaaaagccgtatttcatccggtgttaaaagttcccttccagtctgctgataattcaccgaatagctgccgctacgcccttttgtctgtccgtaggtattggtatccaatgtttcttttcccaataattccgagacatacttatgtccttctttttcatttccacccagatataaaaattcatcgcagttgccgatcagactctcatacgagtctttaaataaggctttcatctgtgcgatattctggatgatgatactgcaggaaatccctctggaacgcatggttgccagaatcttgtcaaaatcatccggcaaggctacgtttggccattcatccataatgcagtgtaccggaattggaagccttcctccgtacttccggtctgccacataatacagtgtctgaaacagattactgtaaatcatgccgaccagataattcatgctggtgtcggcatccggaatacagcaaaacagtgctacttttttctccccgatactgtataagtccagttcgtctgtacaggtcagatttgcaatctgtttcaggttaaaagctgccagacggacaccaaccgagatcaaaatagactttgcagtctttccggctgcctgcttataaatggcatactgcttgaccgcaatactctccgggtcccgcatttccagtctttcaaacaaaatgtccaatggggactggtaatcctcatcatcttctttgacctgagcgcttccaagcatttccatgatcatcggaaagttctgttcttccggtggagcctcatgcagcaaatacagcataagtgcctgtaaaagtgcagtctcggacttctcccagaacgggtctgaactctgcgctcccttcggtgttgtgttgcggatcaggttattgatcagcttcagtacatccttatcatcccagacatacgcaaacggattataacaccaggaagtctccggattgatcaaatcaaaaacccggacttcatatccattccgttccagaacacctccggttttacgcaaaagttctgccttgggatcagtaatcaccatcgaacagttgcactgcatgatgtttgggattgcatacgtccggctctttccagctcctgaacctccgactaccagcacatttaggtttcgtttgtgcttatagccgtccagtcccatacggaaatgctgtgttaaaagcagattttgcgtgtatcgtttttcgcagtaacgtctgcagatttcggacacgttgccccattttgcggaaccatgttccacacctcttctataatttcttttttgggattcataaataccaatgcctaagaaataggctgctgtgaatatcagaatacatttgaacgtatacggtgtatacgtgataaaaaacggctgttcgagtttttcgctcagcgtttctaagatttgaataaaattcttatccggtgcaatggcacaagcggtaatcgctgccgcccaccagacaaatggcagaaagacaagacacagaaccaagtcctgcttttttttacttatctctgcaagtcagattctcttttcttgcgtggcttttcttctggatgttcctgtccttctttcttatgaaaggaatccactcccggtatcagtgagagacttctgccgttgtcccaactgatgccgagctgacctgcatcatccacatactgcacagttccttccagtccctgcggcatacccgcttctccgtccatcgaatccagacagattcttgttcctgccggatattgttctctaagtcgtgccactttttctcttgaataaatgaccaatcaaccactcctttctctaccagaacatgtgtctggtggtattcggttttgcaacctgaataatgattttatctattccatcactatatcttccggctgcaagatatttacttctaagcctgttcagtgccttacggatctgcctttgttccccggctgtaatctgcagccgtttctgggcgaggtcgtattcacttacttttttcagaagagctttcgtgtgatctgtatgactacctggaggatgaggaaaaacataaaaagctgttcaaaggagtgtatatgacgaattacagctgggcggaaaacactttgggaacgttgttgaatcaaaaagaataatgggaaatatagcaaaaatcgggagactgttatcagacagcctcccgatttttttgaagagattttattggactacacattctttgtacagttttttgattgtgaatgtctgctgtaaaaggaataaaaaatgaatggttcaaaagattttgtaaaagaaacgaaaaaaggatgaaaaagaaacgtttttggacggaaaagaaacggaaatcggttgtatggatgtgtaaaatgaggaaaggatccgaaaataaaaagaaagagaggaaaaagaatgagacaattgagacggctgttatccgtttgggtaatggcagtaacgatcgtggggatgtcgatgacggcatttgcacaggaaagtgtatcgggggcaggaggtaatggcagtattacgattgagaatgcatcaaaagggattgtatattctatctataaagtatttgatgcaaaagtgaatgcggaagggacttcggtagcgtatagtacaaaaaattttgtagataatccgtattttgagaaagattcggtaggaaacatatcggcgaaaaaagaagcatataaaacagattctaacgaacagctttcagaaggtgcaattgaatggattaaggagaatggaacaaagatatgcagtgaaacatccgatggctctatattaaaatttaccggtcttccatacggctactattatgtcaccagtactttaaaagatggcggtatgatcatggtaacgagtgttgcaaaagacgcgcagatcgtggacaaaaacagtaaggagccgcagtggactccggggaatgacgggaatgccggagggaaaagtattgtacttgacgatggtaaacaggtaaaggaaaataatgtcagtatcggtgaaacggttcatttccgtttacagatcaacacctcaaattatgttgcagacaagcagatcaaggaattcattattgaagatactcttccgaccggatttgatgcagcaaagattacatctgtgatgattgaagaagaaccgctggaacagtttgaaaatacaactttcccggttacgatcccttgggcagcggatgaaggagaaaatggctggaaaaatctttatgataccggggcaagaattaccattgattatacggctgtgttaaacgataaagcagtgatcgacggtgaaggaaataagaacagtgccaaattttcatggaattatacgacagaggaatcgggaaaaagctcgatagaggactctacaacaacagatacctatgcggttgtgatccagaaggtcaatgaaaaaggagaggcacttaccggagtggaatttgaagtgccgttcccggttcaggcagaagaagaaagcggtgtgtatactgtaaaaggcggacagaccggaacaggaaaggtgaaagccggaagagatggagctgtggtgatcaaaggtctgaagatgggtgattacagagttacagaaacaaaagcaccagaaggatataacaagctgacggagtcatttctggtaagtgccgaaaagatcagggcgacaaggacggacgccagtacatatcttgatgaaaacggaaatgttacagaaagtgagactgagacaaaggtaacttatacaaatgcagattttgcagcaaaggtaaaagttgttgtaaataaatcaggaaaacttcttccggggacaggtggaacaggtgaaatgatctttacggtcagtggagtactgattgcaattgttgcaggagctgtcctgttgaatacaaaaagacgaaaacgaattgtatgatagtgaatgagccggaacgaaggggaagacttttcttttttatatggacaggaatccttcttgtgggaatcgcggtcatgctctatccaaaagtcggaaagatctggaatgccggtcggcaaagcagggtggtagatggatatgaaaggtcagtggagaagctggatgccaggaaggaagaggaaatgatcgcacagacaagagcgtataatgtgatgcttctggaacagaataacccagtgccgaatgacaaaaatgctgatagttatggagcacttttgaatatgacatctgacggtgtgatgggatatctggaaattccggaaatccgggtgaaacttccgatttaccatggaacgggtgattttgcaatctgcaatggcgcaggacatgtggaaggaagcagtttcccgataggcggaaagggaacacatgcggtgctttcttcccacagaggactgcagggggcgaaacttttttcggatctggacaagctgaaggtgggagactattttacaattacagtgctccggcagacgattttctatcaaatcgatcggattgatattgtagaaccggaggaaacgggactgcttgccctggataaggagaaggattattgcacattactgacatgtacgccttacggtatcaataccaaacggcttctggtgcggggcgtacgctgtgaggtgacggagagagcggagccgatccggacaggcgagaagacgtatcggggatggtatgctgcaatcggactgaatctgtttgtggcaggcgtgatcttgtgctggaaaaggaagaaaaaaagaagaggataaatataaatgagggggataaaaatgcagacagtatttgctgaaaaaacagaagaccggtcgctggatgataacagacatatcggggagcttttctttatccggatgtactgggaaaaagggaggattccgtctggaaatattttgtactggaaggatgccaaaagagaggatgcacagatcaatttcacaggatttgacgggcttttgctgtatctggatgaaacttgcgagcagaatggtgtattactgcggaaagcacaggtcagaagaaatcagaaaagaagacggtatcttgaagcgggaaaggaactggagctggtaaaaaaatcggagcatgcagctgttttctggttaaaagtaatgggacgggagttcgcatcttttcaggggatagtgcatatctggggaagagattatccgtaccggagcggatttgagctgattatactgctgaaagatattgtaggatttacagagagaaggagtgtaaggaagaactggaaggcagagagaaactgacgataaaggattgagaagttctgaaagacatattataatgacataagaaactacagacaagaagaacaggagatgcagacaatggaattatgggatatttatgatgcagataagaaaccaacaggaagaacgatgaagcgcaatgactggtgtctgaagaacggggagtatcaccttactgttcttggcgttgtagcaagaccggacgggaaatttctgatcactaaaagggtaatgacgaaagcctgggcaccgggctggtgggaggtatccggcggtgctgcgcaggcgggagaagcgtcttacgatgctgtattaagagaagtcagagaagaaacaggactggatgtaagccgggcagacggaggttatcttttcacttacaaaagagagaatccgggggaaggagataattatttcgtagatgtgtatcgttttgtgatggatattgatgaaaaagatctccatcttcaggaggcagagacagatggttatatgtttgcaacattagatgaaattaaggcatttgcggcagaaggaaagtttctgcattatgacagtataaagaaagcatttgagatgtaagtaaaataaaaatcggattatcggggaaatgacagatcgcctgataatccgattttttataaaacagaaactctgaaaaaatatgcaatacatagcgagtatctgtttctttctgctacttgcaatatgatgcaatcactttcaacaccttatccatttccagtggctttgcgagatgctcattgattccggcattctttgacttctggatatcttccgcaaaagcattggcgctgagggcaatgattggaaccgttggggcatcagggcgggaaagtccgcggatcgcctttgcggcatccagaccattcataaccggcatcataatatccataagaatgatgtcgtattcatatggctttgatttttcaaaaagccggacggcttccagtccgttgatggctgtggatacattaagtcctgcggcttccagagagaaaacagcaatctcaaggttcagttcattatcctctacaacaagaatatgaagatccgtaagatctgccggagtatcagtggcagtttccgcagaggcggaaggttgatgctcgtcaatggtaaatggcaggatcagagtaaaagttgagccgacatttttttcacttttcaactggatcgtaccgcccatttcctgtaccagtctgtgaacgatcgccataccgagcccggtccctttgtaaatcgtccgggcaccggtatcttcctgtgcaaaaggttcaaaaatatgcttctgaaattccagactgataccgataccggtatcagaaattataaatttgtaaataacattctgatgtacctgcctgatgatctttgcgtgtatagagatcgaaccaccgggcttattgtatttaattgcattgcttaaaagattcatgaaaatctgacggatatgtaatggacttccgatcagataaggatattttaaactgcccggttttattttttccagagtgatatcaagccgggaagcctgtgcctccagcatactccagcaattgtcaaggatctcgcggatgtcgaatggtatctgttcaaggaagaatcggtctgtttccatccgctgcatatccaggacatcgttgacaagagcttttaagtgaaaagcagcagtacgcattttctcatgacactccagcagtgctttgggatttgtttcatttttctgtgcaatatcaagcattccaagaattccgttaagaggggtgcggatatcatgtgacatccggttgaggaagtcggtcttggctgtatttgcctgatttgcggattcgaccgccttaaccagctcctgctggtaagccagttctttctgcttgtaatcatcgatgatctgggttacataaagaatttctgtaacatcgtcatcagtgtcgcggttctggacgataaaggtggcacggcgccagatcccctgtggagatggatactcccggcttataaaaagctttccgtgcagccggtcatttaccgttgtcagatcaaagaaatactgcatgatctcgtgatgtgacggtgcaaccattttctcaaggatatcatttaactgcgcagtggcggaagtgacaactccggtcggtgtatagttctggttggcaccggcaagcttttcaatccggtcttgaatcagatcgatatggtaaattgcatgataaatctgactggttgcagcggtcaggttctgatatttacgttcattttcgatattacgggtgacatcctgatgatatccacggatgcatattccatttccctgataatccggatagaggataccgccgcatcgtatccagatctgtccaagtaacggatgattccatgggtatgtgatttctgaataactttcgtgaatgaccttctgtatataatcaagcaccggggttacgtatttgggaggaatccggtgataccagaactgataaacttcttcaggagacatctcttgtgacacaccaagaagagtacacattgtaggatttgggtgcagccggggagctttaacgccatccatctcaagcgtacagataccgatctgtgcgccacgaagaatttcgtccatctccagctgataatccagacgggatttggaggcaacaacctccaggcgcatctgctcattcttatgatctttgatcatggttccgacatattttccaagaagggacagcaggcggtggatcaggctggatttctccatatctggattatctacgccaacgaaaccaatcagcttttcgtgtacagaaataggaaaggcgatcagggtagaaacgttctgaacttttaacagttcatattccagaggcatagattcacggtaagcctccagatcttcgatcagaatattttcaccatgaagaaaaacctcgatccattttggcatgctttcaaaaggaatatcatgcagattccggatctgcggggtgactcctgcggcgcaccactcataagtattggtagaagtatgattttcactggtttcaaatacataagcacggtcggcgtctgtaaattctccgatcgatttgagcataaaattgataccgtcagccagatcctctgcttcatgaagcagggaaatctgatctgtcataaaacgttcggcttccagctcagcatataaagttgcattatccttgtcattattcataaggaagttcctctcaagaaaagtgtaaagtttataaaattactttaccttgtttttgcgaattcgtccacgaaaaatttgaaatacaaacaaattgtctggtggtttacaaaaagaaggaatgattctataatttcaattagacgaaaaagattttgtcaggagataacaggaggaaaatgaaatggcttgtacaacaatactggttggaaaaaaggcatcgtatgacggctctacgatgatcgcaaggaatgatgattcaccgtcaggcgcttatatgccgaaaaaatttgtggtgattcatccggaagatcagccgaaggtatatgaatcggtgatttcgcatgtgaaaatagaattaccggagaatccgatgcgttataccgccatgccgaacgcagtcaagggggaaggaatctgggcggcaagcggggtaaatgaagcgcaggtaggaatgacggcaaccgaaacgatcacatccaatccacgtgtgcttggagcagatccgctggttacatatcagccgaagtcagacgaccaggaagaaattgcaggtggaatcggggaagaggacattgtatatatcgtgcttccttatatccacagcgcaagagaaggcgtgcagagacttggaagtattctcgagaaatacggtacttatgagatgaatgggattgcattcgaggatgtaaatgagatctggtggctggaaacaatcggcggacatcactggattgccagaaaagtgccggatgaggtttatgtggtgatgccgaaccagcttggaatggatgaatttgatctggaagatgcacttggtgagcagaaaaattatatgtgttctccggatatgaaggaattcattgagaaatatcatctgaacccgtccatggatggaaccttaaatccaagagatgcttttggaagccatgatgactcggatcatgtatacaatacaccgagagcctggtttatggaacgttacctgaatccaaattcatacagctgggacggaccggatgcagattatacgccagtatccgatgatattccgtggtgtatggttccggaaaagaaggttacagtagaagatgtaaaatatgttctgtcttcacattatcagggaacaccttatgatccgtatggagcttacggggacaaatcaatgaatggtgcttatcgttccattggtatcaatcgaaatgattttatgtctttgatccagatgagaccggatcagccggaagattcccgcgcaattgaatgggtggcatttgcatcaaatgcatttaatgtaatggctccattctatgcagatattgatgaaacaccggaatattttgcaaatacgacaggggaagtttcaacagagaacttctactggtcaagcagaatgatcgctgcgatggcagatgcttcttataaaaagtctattttccatattgagcgttaccaggaacatgtgatggcaaaggcacatcagatcataaaccggtatgatgacgatcttacgaaagaaagtgatatagcaaagcgtatgcagatcaaacgggaagcgaaccgggagattgcgaagatggtgaagaaggaaacttcggatacactgtctaaggttttgtacgaactgagcaatcagatgaagaattcttatgcgagatcggatgcataaatagaatacgagtgggaaaagaagagggcagaaaaataactggaacggaatagaaaatatgggaattacaattaaagatattgcaaaagagtgcggtgtatcggtggcaacggtatccatggcattgtcagataagccgtcacgggtttcggaaaatacaaaaaagaaagtgcgggaaatcgccaaaaaacataattatcgtccgaataatgcagcggtcagtcttgcaaataagaaaagccgtctgataggcattgttttcaatgatttgagaaatacgcatatttcttcgcttttcatggcgattaacggagtgcttgaaaaaaacggatattctctggtatgtcacattatagaagacggtcagactatcgatacagatattatccgtgatattgctgcggataatatcggagcactaatctggtcaaaatcaatggaaatgaatgatatggaaaaacctgattttttgaaaaatgcgatgagaaatcttagtattccggtcattacaatggaaaaatatgggtttgactgtccaggggtagatattttattcgattatgaaaagggcggttatatggcaaccagacatctgatagaatgcggacacagaagaattggatgcgtggctggaaaacaaagttttcatgttacgatgcagcgcctgaatggatataaaaaggcactggaggaaagtggaatttcatatgatccggacttagtgtactttggagattacacgatggaaagcggttatgaggcgttttcgtatatactgggacagaaagtaacagcgattttttcgatgaatgatgaaatggcatttggaatttatcgagctgcaagactgtatggtgtttcaattccggaagatatttcaattattggatttgataatgttccgtttgcggatgtgatgcaggttccgctgacaacaataggggttcctgttattgaaatggggaaaaaactgggcgaaaaagtagttgagctgattgataataaagaaaaactgaaagaaagagaagaaattttgtatacaccaaggctgttggtaagaggaagtacaaagtcgattccgccggttaccgttatttaaaaatctaaaccatataaaactatctaaatcaaaacgcttcaacattttgttgaagcgttttgatttgtgcattaacaacgaaaatgcataaaatagcaatggaatattgatatttgtttgtgaaaatggtatgataaccatgtcgaaaacgataggcaagaataaaagcaagttaaacgatttaacacaaaggaggaggaaaagtggagaaggaaacaattatcgaactcaagaatattcggaaagagtttcctggtgtagttgctctggataatgtaaatatgaagatacgggcttctgaagttcatgcacttgtaggagaaaatggagctggaaaatcgaccttaatgaagatactgtccggtacttattcaaactacggtggatccgtaatctgcaaaggtgaagagattcatatgaaatgtgaaaaggatgcatttaaatatggaatttctattgtagcgcaggaattgaactatgtttcagaattaagtattgcagaaaatctgtttctgggacgtgagccgaaaaaaggaaaagtctttgttaataaagcagaacgactaaaggaaacccagagattacttgatgaaatgggacttgattataatccgagggaaaagatgggaaatctaaatgtggcacagcgtcagatgatagaaatcctgaaatctttatcgcgggacagcagagtgatcatcatggatgaacctacatctgcacttacctcaaaagagtcagagattctttttagtaaggtaaatgaattaaagcaaaaaggaattgcgtttattttcatatcacaccgactggaagaggtctttgaactgtgtgacagctatactgtattaagagatggaaaatggattgcatctggagatatcaaagatgtagatacagataaactgattgcaatgatggtgggacgtgatatcaaggatatttaccctccgataccgcaaatcggaaaagacattcgccttgaagtaaagaatttaggaagaaaggatgtgtttcagaaagtatcttttcaggttcataaaggagaaatctttggtttggcaggaatggtaggtgcaggacgaagtgagattgttgaaactctttttgggcttgcaagggcaaatgaaggggaaatcatcctggatggaaagccgataaaaattcgatctgtaaaagatgcaatccaaaatggaatcgcaatggtaacagaggacagaagaacttatggatttgtcggtgtcagatcaatcagtgataatatcattcttccaaatggagatttatttgcaaaaggtggcatttgggataagaaaaaagtacagcagaaagttgcaaaaatctgtaaaagattatctgtaaaagcaccagatgcaaatacattggttggaaatttaagtggtggaaaccagcagaaagtagtacttgcaaaatggctggtaagaaatatcaaacttctgatcctggatgaacctaccagaggaattgatgtaggtgcaaagcaggaaatatattctctgataacagaatttgcagaacagggactggcaatcatcctgatttcatctgatatgccggaagtactgtcaatgagtcacagagttggtgttgtcggcggaggaaaaatgcttggaattctggatcggaatgaaatttcacaaaataagattatgaagatgatagtggaggcaaaaggcgatgaataagaaaaaagcattatcttcaggtgagctttacagaaagtacggaatcgtaattattatgatcattctgtttgttgcatcggcagtgatcaatcacaactttctgaaacctcagaacctgctcaatattttaaaacagatttcagttgtaacaattatagcatgtggtgaaacaatgctgatcgtatcaggaatgattgatttgtcagcaggtttcctgtgtacgacatcagcctgtgtatcggccggagttcttgcatcaacaggacatttatcactggctcttctagtaggaattgtaattggatgcgtatgtggatggattaatggttttctgatcacctattataagcttcagccatttattgcaacactggcaatgacttatgtattaaagggtattgttcagatatacaccaacggtcagacaattgggggtgtgaacaaagcgagatttttaggacatggctctattttggggattccggttccggttctcattatgctcctttctgtaattgtgatcgctgttctgatgaaatcaacaaagtttggaacttatatttatgcgatcggtggaaatgagcaggcaacaattgcatccggaatcaatacaaacagaacgaaacgtctgatctttacacttagtggtgcacttacaggacttgcgggtgtagtactgatggcaagactgatggcaggtatgccgtctgttggtgagggatatgaatttgatgcgatcactgcagttattgttggtggaaccagtttccttggtggaatcggaacggttacaggagcgctgatcggttcaattattgtaggtcttatcaacaacattctgaacctgcttcatgtatcaacacagtatcagttaattgtaaaaggtcttttaattgcaatcgcagttattatcgatattaagacaaaagaaaacaaaaagagtaaataagtaaaaggagaaggaaaatgaaaaaaagattactttcaattttaatggtaacagcaatgtgtgcaacaatggtggtcggctgtggaacagcagatgatacaaaggacagcagtagttcttcaaaagggaaaagcgattatctggtaggatttgcaaataacagtgatacatataactattgtgcaaagttcagatcttatctgaaagatgccacagaagcaaaaggaatttcaatcacagtaacagatgcaggcggtgatacaaatgttcagaacggacagatcgatgattttattgtgcagaatgcaaatgttgtatctgcaatcagtaatgaccttgacggttcaattccggcacttgaggcagcaaaagatgcaggacttccgtatgtatcattccttacttctgtatctggtggagacgactatgacggatatatttatgtgggttcgccaaatgaagatgcaggaaaagcacagggtgagtatctgtgtgaagcattcccggatggagcttcaatcttgtattttaccggtgcgcaaggaacagattcggtctgtcgtaacctgtcattactacttccggatcctccagcatcaggatatcgatcatatcctctcttacttctttcgtcgctgttgcagtaaatgcactcacaaccggccgctttggaagatactctacaaactctgtgatctttaaataacttggccggaaatcctgtccccactgggaaacacagtgcgcttcatcgactgcgatcatagaaatatccacgctcatagcaaaatccataaactctgcagtttccagccgctccggtgccacatagataatcttatatcttccttcttttgcaaaagcaagtgccttccggtactgccccatagtcagggaactgttcagataggctgcatgaacccctgcctggttgagggatgccacctgatccttcataagagaaataaggggagatatcacaagtgtaatacctcccatcatcagagccggaatctgaaaacagatggactttccagctcccgttggcagtatgccgagtacatcccggccggacaggatcgcatcgatcagtttctcctgtcccggtcggaatccgtcatagccaaaaaattgctttaatacttgaaatttatccaagatatactacctcttcttccggtttttctgcggattccatctccagcatataaagaaccggctgctttggaaccatcggacggtacgcttcgtactcgaacttgacggttacttttttccagcttctctgtgtgatctgcgctgcccttccaagattacatggatatccatagaaacggatatcatctgcgcaacaggtcatgatctgtcttcccggaatcagcatatttgccggcattcccttcggacggaaaagctgtgcaaggaaggtgatcttcttgtgctcgtaacgctccggatgctcatatgcatccacataccaggtcccaaagtccacatcatcaatgaagatatggtctgctttcagatcatatggcagatcctcttctgtctgcgggataatattgccatccacgccttcaaaaatcagctgtgcctgtgggttctggatcttaagggcacgtctgaacgcacttcggtctgtattttccccacaacggttgatgatgatcaactcagattctgtaagctggttcatcagcatattccgcatattcttcaggtacatgtccagcgtctcaccgctaaccgttgagtacacaccctgaatctcccagttgcgtgggaaatcttcatccaggatttcctgtagatcccaggttccattgtactcaatgatcacctggaccggatgatagatcttctcacagttttcaaagaaagttttatttaacttttctctttcttctatattgaagaggaacagtccgttctcatccagatatttttccgagtactcttcctctccctcttcacactgcaaaagcaatgtcggaccttcttcgatccattcctgcttcatcagtgtgtctttgataaatgttgtttttccactgtccagaaatcctgtacagatatataccggtgttgtcatcgccgcttgctcctcctagatatggaataacttaatcagatcctcttctttgagatctgttccgatcacgcatacacgtcctgtgtaatcagcctgtccctcacggacttcatattcttctggaaccatatcaaactgcttccaggaaccgtctgccatctggataattcctttggaacgaagtacggttccgtaagcatctgtctcagataatgctttcagcaggtaatccagttcttcttctgtatacttatgagcagtctccttgccccagctcgtaaatacttcatctgcatgatgatgtccttcgtgtccgtgatgatggtcatggcatccgcaggtgcagttctcatcatgttcatgatgatgctcatgctcttcatggtcgtgatcatgatggtgttcatggtcatgatcgtggcatccgcaggtgcagttctcatcatgttcgtgatgatgctcatgctcctcatggtcgtgatcatgatcatgaccgcagccacattcgtcatcatgatgatggtgatgttcgtggtcgtcatgctcatgtgcatgttcttccaggataccttcgatctcagcaccatgctgcagagcatgcaaaacggcatcttttccaagttcttcccaaggtgtggaaataatggttgcctctgcatttttctcacgcagcatatgcacgcactcttctaccttttcatctgtcatcatctgggtacggctgataacgatcgtagatgcatgctctacctggttattgaagaattctccgaagttcttgagatagatctttgctttcttaccgtcaacaactgtgattcttccgtcaatctcaatatctgcctcatctttgacaccctcgattgcttttacaacatcagaaagctttccaactcctgaaggttcgatgatgacacgatccggtgtataatctacaagtactttctgaagtgctttgctaaaatcccccaccagtgtacagcagatacatcctgagttcatctctgtgatctcaacgccggcatcttttaagaatccgccatcaataccgatctccccaaattcgttctcgatcaagaccagtctttctcccggaaatacatcctcgatcagtttcttgatgaatgttgtctttcctgctcccaggaaaccagaaataatatcaactttcgtcatttttcgttcctcttttcttattattatataatttcataaattagccttttctaactgcaaattgtttccgagctatatcgtatcacatttctttaaaagatgcaaataaatagcttgttaatgcattgtgattagtgtataatagttttataaaatctcgtacttttttagtacaaattcataaacaaaggagacttgataatatggttaatttattgacaggcccaaaaggaagcggaaaaacccagcaaatgatcgaacgtgctaacgaagctgtaaagacatgtgaaggaaacgtattcttcatcaagaagagccacagagatacatacagcttatctttcaacatcagagcgatctgcatggatgactatgatgtaatcaccaataccgatgaatatcttggatttatttacggtatgttaagcgcagaccatgatatcaaagcaatctttatcgacggtattttaaagcacgccgacatcacacttgagaacattccttctttcatcgaaacactgaaaaagatctccaaagaaaatgatgtagatttttatgtcagcatcagtgcaacgaatgaacagcttggtaatgtaaattttgaagattgtacactccttaactaagatagacattatccaaaaggagggatgaagattttctgtaaatcttcatccctccttttatggttttccaaatgtgacagagcacattctttttatgctatgataccaggggcaaaaggtcagaaagccgatgcaaacttgcttgcaagaggatttttgcactctcgcaatctggtatcaaaggggtcaaaataccttttgaccccaacatcatgctatttcaaagacaaaaccgtatttgccttatccccttttgcatactccagttttacatcatctcccacattgtacttgatgatctcaataaaatcgactaccgatacatcaaaaatctcatctgatccttccagcataatgtagtaatgagaatctccatctataacaccctgggcgattttcgtgatctttccttcgatcgtgccggtatccatcttcacttcttctttttccttgattccattggtaagaagcagattattgtaggattcttcacatacacttaccgtatccccgatcgcaacaacctggtacttctggacattgaccattgcatactttttcacaagtcctgcatcatccttaagtgccataaagtaagtcggctccccggaaatgttaagcaacagtgggaaagtcgcccgatacttcaggttctgtacctgtccttctgccgatgccatcgcagaatcctcgattgcacctgccaccggataatactttgtctccatagttctctggttcatcagaacaaatcccacattggactggtcactgtttacagaagttactcccgtgtacacccatacatcatcatcaatcgccagataattatatccgtttgttgtcttcagacaatctttctggctgagtacactgttaaaatacccatgctttaacgtgccataataatcataaagctgtaccagaagatctgccgaataggctcggtcgatccattccgggacttcatcgatcctgtagtcctgcatttcgccggtgatcgcattgcagagcaccacatgccctaccgtttctcctccgaaaagaccgatattatactttttgaccggtgctacccagtatggaacaccattatcatcaatttcaaaactaaggtctccgtaaatataagtcggatgcgcaaaacgaagatgacggtatatatttcttccaaaatgctcgctggtcgaatacttcattccctgctccagctttaccatctccgttgtctgacttgccatatcgatccggatatatgcaggaagtccatctttccgattggtaaaccatttgatcagattcgcatatttcaaaggtgacacacggaccggacgatccttgtagttgatctgactgtagatatcgtccacctcaaactgggataccatatctgacatgcttcccatcttccggtctcctaaaagctgcgcagactccttatccagaagcgggatctggtcaaaggaaagctcctcgatatcttttgtgaattcgccctcttctaccttcagaagctgttggtatttcttcgcattcacaatcggtgaagaaagaatggttccggccagataaatcactaacaaaagaataaaaagacggacacaccatttgaaacctttggattctttcatctccttcagatcaatcgctccgtatcgcaagcctttttttcctgcaagcacaagaccgaccgcaagcaccagaacaagcacaaaataccacactccggaagaatggatattaaaagccggcagtgatacataataccagattcctgctgccactaaaagcagcagaaaactgatcgctatatttttctttttcataaattctccttttcatcgttttgccttaccgaagctgtcttagaattttctactccaaagtgacggcgagaacagcatcaagaacgggaagatctccagtcgtccgatcagcatatccacgcagaacacaatcttcgagaagtctgagaacttcgcaaaattttccaccggtcctaccagattcagtcccggtcctacattattaagtgtagtaagcactccggtaaatgaagtagtaaaatcaaagttattgatcgagatcagaagcacggatacgatcaggattagtatatacgcaataaagtatacatataccccccgcatcgtctcttctttcacttttttcccatttacttttacgatattgactgctttcggatggatcatagttttcagctcccggcggatgctttttaccaggatcagaagtcttgatactttgataccaccgcctgttgaaccggcagaagcaccgattaccatcacaagaagcagaacacatttggaaagctccggccacttgttgaaatctgccgtcacaaatccagttgtcgtgatcacggatgccacctggaacgccgcatagcggaatgcctttaaaagagaatgataacctccggcgatattgcaggtgattacaacggttgctcctgcaatgattcccaggtaagcacgcagctcctcattcttaaatacactcttaaattctttcaaaagcagaaagaaatacaggttaaaattgataccaaacaggatcataaatacggtgatcacaccatcaatgtaggcactgttgaagtgtgccacacttgcattgtaaccggaaaatcctccggtaccggcagtactgaatgcatgtgtcactgcgtcaaacaggttcatccctcctgccagaagaaaaactacctcaattgtagtcagtgcaaaatacattccatacaggatccttgcggttcctcttgcctttggaaccagtttatctgcctctggccccggaacttccgcacgcatcagatgcatggaattcttctcatccagagaggtaagtaccataacaaataccagcactcccattccaccaacccaatgtgtcagggaacgccagaaaagaattcctttcggaagtccttcaatctcagtcaggatcgtagaacctgtcgtcgtaaatccggatactgtttcaaaaaaagcatccacatagcttggaatacttttactgagtacaaatggaagtgcacctgcaagtgaccagaaaatccaggccgttgcaacaatgatcagaccttctttggcataaatcgtcatgttctccgggcattttctgccaaacagcagataaattgccgtcaggatcgcagctgtaatcagaaaataaaccgatgtatgctcgccataaataattccaaccatcatcggaagcagcatcagcagtccctctgctcccatcatcttgctgatgatatagcgtatcattttcacattcatttcttttcacccctattgctcagccagaatatctgtgatatccttaactttcttctgggttgtaacgattacaacactgtcgcccacctgaatggattcatccccgtccggaataatgatctgccgttttcttccgatacatgcgatcagattgttcggcttcagttccagatccttaaacgggatatctgtatattctgttttttctttgataataaattccagtgcttctactcttccgccaaccagctgatacatagattcaacattgacattcttgagagaattctggcgtgcacgcacataactcatgatcgcatctgctgttgcagtctttgccgatacgatcagatcgatcccaagttcctcgacaagctgggcacgtccgtcttcgttgacctttgccacgatcttgtccacaccttttgtctttgcaaaaagtgcaaggataatattctcctcatccataccggtcaggctgaccagggcatctgcctgttcaattccttcttcaatcaaaaggtcatggtctgcggcattcccacagatgatcgtcgctttcggaagctggtcgcagagatcttcgcatttcttccagtcctgctcaatgatcttaacctgcataccaagtcctaaaagctgttttgccagataatatccgacttttcccccaccacaaaccagaatattcttcggctctttccgctttccgatcagatggaaaaattcttcaatatatttgtgggatgcaacaatatgaagccggtctccatcatggatgacaaaatcaccattcgggatgatcacttccgatccacgtcttacagcacataccagaactttgatctggaacttgcggtaaagctcagcaagcgatactccgcccagatggcttctttctttgacaatgaattctaccatttcgacttttcccttcataaaagtctctacctttgcagtatccggaagaaggatcgatctggaaatctcaaatgcagccgcaagttccgggttgacagccatactcagtcttaagtcctctttcaaaagatcgatctgctgataatagatcggattccttacacgggcgatcgtgtgctttgcccccagtctctttgcgagcaggcagctcagcatattcagttcgtctgtcgatgcacatgccacaacaagatcagcgcccggcactcctgcttctttctgcactttcgcatctgcaccatctccggtaatgcagagaatatcaagctgattcagtgcttcttttaatttcccctcattctggtcaatcaaaaccacatcgtaattttcttcggataactgtatggtcagtttatgaccaaccttcccgtccccaataattacaattttcatttttcttttcctctactttttctcttaatactaaacctttaatactaaaattgtataaaataccaatgtgacagccgaagctgccaccatcataatatgtataccacttttagtacgaaagtacaatagaaaaaaccgggattttctcccggcttttccttattcttattcttcagctgcacgcttttcaatttctttttcctgtacatctgccggagcctgttcataacgggcaaattcatacgaatagcttcctcgtccacctgtcatagaacgaagtgttgtgcaatatccaaacatgcctgtcatcggtacatccgcttcaattacctgatatccgcctgactgtggattcattccaagaacacggccacgtctcttgttcagatctcccataacgtctccggtataatcatccggaacggttactttcacagatgcgattggctcaagaagaaccggtcctgcttccataaatcctttcttaaatgcctggatcgtcgcagtcttaaatgccatttcagaagaatctaccggatggtaagatccatcatacagagttgctttcacaccaactaccggatatccggcgagaggtccttttaatacagattcctgcaatcctttttcaaccgccgggaagtagttcttcggaacagcacctccgactacttcttcctggaatacatacggtgtatccagatctccggatggttcaaaacgcatcttaacatgtccatactgtccatgtcctccggactgtttcttatacttggtatctacatccgagttcttgcggatcgtctcacggaacgcaacttttggtgtctccagtctgattccgactttgtaacgctctgccagcttgcttgctgtcacttccagatgctggtcacccattccataaatcagtgactggcggttctcactgtcatttaccactttcagtgtcacatcctctgccatcatcttcgcaagagcctgtgataccttgtcctcatcacctttgttattcactacatacttcatatatgtatacggtttggagtattcggttcttccataagataccggtgtattttttgttgaaagggtatcccctgtctttgtacttgtcagttttgcaatcgctccgatatcacctgcaaacagttcctgaacttctaccggtttgttgccggataaggtgtagatcttgccgatctttgcttctgcatctgactccggattgtaaaggacatcatccccctttaatacaccggaacatacttttacgaaagaatattttccgataaacggatctaccatggtcttgaatacatatgcggtctttgcggctgcaaaatcatgatgtgcttcaaagatctcattggtcttacggttgatgcctacgcattcacggtattccggacttgggaaaaatcttacgatatcagacagtaagtttgcaacaccctgtgcctgaacattggatcccattgctaccggaacgatatctccgtccataacttctgttctcatggcagagcggatctcttcaaccgagaattcatctccctcaaaataacgttccataaatgcttcactggtctctgccactgcttcaagaagcttctctctgtaaatctgcaggttcggcagacagtaatccggaatctcacactcttctctctgtccaagtccggtgtatcttctacctgcattcttgataacattgacataacctactaatttctcgttctcacggatcggttggaaatgtggtgcaatcactttaccgtatcttgcggtcagatcttcaacaacctgacggaagctggcatcatccacatccatctcagtaacatagatcatacgcggaagattatacttatcacagagctcccatgctttctcggttcctacctgcacaccggcttttccggaaacaacgataacagctgcatcggctgcgctgactgcttcttccacttctccgacaaaatcaaaatatccaggtgtatcaaggatattaatctttgctttttcccattcaatcggaatcagacttgtgctaagtgagaatttacgtttctgttcttctttatcaaaatcactgatcgtattaccgttctcaacagatcccatacgatttgttgctccagatacataagccatcgcttctgccagactggtctttccgcttcccccatgtcctaaaaggaccacgtttctaatttcatccgttctgtaaaccttcatgcttgctgcctccttgctaaagtttctcatggatatattgtactaaactttccataaaaacacaactattttatagaatttcaacaaaaactttcacttttgcactttaaagtattgctttattgacagatagcctgttttcctatattatgaaaggtagactatcacgaaaggacgaaaaattatgaaacagaaaaaaatcggatttatcggactcggactcattgggggctctattgcaaaggcgatccggcgatattatccggattatgagattgtcgctttcgacaagaatagagaaactctggcacttgccacacaagaatccatcatcaatgtggcctgtacctcaatcgatgataatttccgaggctgcaactacatcttcttatgtgccccggttgctttcaatactgcatatttaaagcagatgatgccttacctgcatgatgatatgatcctgactgacgtcggaagtgtcaaaactccgatccatgacgagatcatccggctgggactggaggattactttatcggaggacacccgatggccggttccgaaaagagtggttttgccaattccaaaccaatcctgatcgagaacgcttactttgttctcaccccttccgccaaagtagcgaaaaaaaaggttgatgcatacgcatccttcgtagaatccttgcgtgcacttccgatcgtactggattatcatgaacacgacatcgtcaccggcacgatcagccacttgccacatatcattgccgcaagtctggtcaactttgtcagagacaccgacaccaaggatgagctgatgaaaaccctcgccgccggcggctttaaggacattacgcgaatcgcctcttcctcaccgaccatgtgggaacatatctgtgcacagaatcagagtaatatttcccagatccttggaaattatatcgaaacattaaatgaagcgaaaaaactggttgatgccggagactcccagggaatctacgatatgttcgaccattcccggaactaccgcaattccatgccaaacggttctgccggcccgatcaagcgtgcattcgagatctactgtgacatcccggatgaagccggtgtgatcgccaccattgcgaccatcctcgcttctaatgcactcagcattaagaacatcggaatcgttcataaccgtgaatttgaagaaggcgtactccgcatcgaattctatgacagcatctcctgcgagaaggcagtagcacttttgcagaagcatcgttatattgtttatgagcgttaataattaaatgatgataccagggtcaaaaggtcagaaagccgatgcaagcttgcttgcaacaggacttttgacactcacatcattaaatgcaagacagtccaaaaaatcttttcagaactttgtgtaaattggtcacaatgcttgaaaatagaattttacgaatgagaggttactattttatgcaaatccaacctgttaaacagcttcgcggggaagtatctgttcccggcgataaatccatctcccaccgttctattatgttcggtgcactggcaaaaggaactactgagatcacacattttcttcacggtgccgactgcctctctaccatcggctgctttcgtgccatgggaatcaatatcgaagacacacctgaccgtatcctggttcacggcaaaggccttcacggactttccgaaccttcttcttttttagatgtggggaacagcggaaccactacaagactgatttccggtattctttccggtcagccgtttgccaccactctttccggcgatgcttctctgaactcccgcccgatgaagaggatcatggagcctcttgggatgatgggcgctgatattttaagccaaaatgggaacgggtgcgcaccacttttgatcaacagcctgcttcctgccggtcagaatccatccctgcacgcaatccactatcactcaaaagtagcttctgctcaggttaaatcttccgtactcctggcaggactttatgcagacggattaaccctggttacagaacctgtactttcccgtaatcatacagaactgatgctgaatggcttcggtgccaacgtacagacagaaatacattctgatggcaggaagaactgttattccccgctgaactgctgttcccggaattattgcccgcagatgtattacttccggtggaagctgacgcctgctttgtctcttcctgtgccttttttgccagctgctcatccgctttcctctgggcttcctcctcctgctttttctgtgccgcacgtgccgcctcaagctgtgcatttaccgtggcaaggtctgtcgaagtctcttctgcttttgcctgcaacgctgcctgttcactgtccagctggctttgcaggtcaagcagttcctgctgcctgcttttcagttcagcctcctgctcttcaataccttcacgtactttcaccatattctccagcatatccttatcgtactttgtaatattctggataaagtctacacggttcaggaactctcccatactttttgcttcacataccatagaaagcagtgtgtccgaaccattttcatacatgtacttaattcgagtcttcatgtttgcatactgtacttcctcgttattacgggaaatctggagcgatgcttccaaacggaatacttcattattagactcttcaattttcacttctgtctcagcgatttcattgctgatcgtaaccagatcctggttgatcccttccaactgactctgtagattactggtcttatcttcgaggctgtccacctcttctgcatgtaccgacatccccgacagcgcgataccgaatgcacagatcagagaaagtccgcactgtacgattcgttttttctgcattttcataaatgtaatcctttcttgaatgttttggggtaacactaagatagtatatactattttaatcaaaagaacaaccttctattttccggaaaggtctgtacacagccattacttcccattttcaacatacaaaaagcttcttcagatgccatttttctctaagtgtatgacagcaaaaagaaacaggctttttgctgatttcaatcagttaagcctgctcccttttcagcagagcctatgctgtcggctctgcaactgttttacttttatcttttttcactctgtatccagcagttgttctgcagatgaccggatcaaagatcaggaacatcgccggaaggacagtcagtactacgatcacactgatgatcgctccccttgaaagaagttcacagatagaaccgatcatatcaacctgtgtataacaagtcacaccaaatgttgccgcaaaaaagctcagtccactagtaatgatcgatggcatactgattctgtgtgcaatcgcaacagattctttcttactcttgcctttcatacgttctttctgatatctggtcgtcataaggattgcataatcaacggttgctcccagctggattgctccgataacgatacttgcaacgaacggaagactcttaccctgatagaacggaatcgccatattaatcgtaatcgcaaactcgataaccgaaaccagaatgatcggaagcgagatggatttaaatataagcaaaatgataataaagattgctgcgattgaaataacgttaacccttgtcaaatcgatatctgttacatcctgcaggtctttcatcagtggtgcttcaccgattaccattccagacttatcataggattttacaatcttatcaatctgtttgatctgtttgttgacctgcggagttgcagactcatacttggtacatacaaacatcaactcggtatccttaccctgaagcatactctttacatcatccgggatcatcgattccggaatagaagatccaacgatggagttaagtccaagtgtccattttacacctttgacatcatcaatttcactcatcattgcctttttctctttggcatccatgtctttatctaccataactatatgcattgtactcatatcaaagtcatctttcagttcactgtttgccacatttgatggaagtgactgtggaagtgactgtgcaatattataataaatttttgtatgattattgccataaatagcaggaataagcaagatcaggaaagcaacgatccatactttgtaatgtttggtgataaatgctgaaaccttatccatgctcttgatcagcggtttatgcttggttttttcaatcggtttatcaaagataagaatcattgccggaaggattgttacacaacaaagcactccaatgataacaccttttgccataacaataccaagatctcgaccaagtgcaaatgtcataacacaaagagctacaaatcctgctactgtggtgacagaacttcctacaatggatttgaatgtattagaaatcgcatgtcccatcgcacgattcttatctcccgggaaacggcgcttgttctcttcgtagctattcagcaggaaaatggagtaatccatcgtaacacccagctgcaataccgccgtcagcgcttttgtaatgtaacagatctcgccaaggaaaatgttacttcccagattatatacaatcgctacacctatactgatcaggaaaaaaatcggtaccaggaaggattctccggtaatttccaacaccagaaaagaaagaattgccgcaattacaacataaatcgggacttctttcattgctacattcttgatatcggctacaacacctgtcatacctgcaataaaacactgtttgctggcaatcttacgcatctcaccgactgcattcattgcttcgtcagatgaagtcgtattgtcaaataatgcgagcatcagtgtcgcatctccgttgtagaaggcttttctcaaatcggatggaatcatctctaccggcagtgaaagatctgccacatcaccataccataatactttttcgacatgatcaaccttattaaactgatctgccagcttctggatatctttcatgtccgtatcctctacaacaaccatggcgaatgcacccataccatattcatccaccataacgtcctgtccttctactgtttccagtgattccggaaggtaactgagcaagtcgtagttaattcttgtcttcgccattccaataaatgacggaatcaaaagcagtatccccagtaacaaaattataaatctgtgttttgctatccattttcccgctttgaccacaataatcatctccctgtctttacatttttattctatagaatattatacaaaaaaatgactaatggtcaatatcaaatagtcacaataattttataattaaaaaatgaattttggtcatttttagcatggttaattttttactattttccaaaaactataaactacaaaaaaaactgctactggcagtttttcttgtacacaaacatactaaaaagggtgtttttctggtatattacagagaaacaccctttgctcttagctcttatttacgaatcgtagatacagaatagaccagaattttcatacagatttctttttccggatcaatctctactgtaaggatttcaccatcccgttcttttactgttgcgataatccctcccattgtaagaacctcatctccaaccttgattgaatcatggagttcctgcatttttttattctttttctttcccggaactaccatcataaaatagatcactacaaacaatagtaccgcatacaataaaatcatcatctgtgcattcatactcttatcctgccttttttgctttattatactacttcagataagcttctacaatctttacaaacattgctgatcctttgtagagcacgtcttcatctacattaaagtgtggattatgatgaggaacatccgtatgctttaccggattagaagaactaaggaagaaaaatgctccgggtgctttctgtaagtagtatgcaaaatcctctcctgccatatttggtgccggaactttacttacaacatcctcttcacctacaacttcttttgcggcttcagttacaagtgctgccatctcgtcgttattgattaccggaggtgctccccagtccatctcaacttctgctgttcctctgaatgttgccgctgtgctctttgcaatctcttcaattcgttttgcaaggtactgtctcatcggttcttccagtgcccggatcgttccttcgatttctacttcacttggaattgcattataagcaacaccaccatggaagtaaccaattgttacaactgcagcttttactgcggaaacttcacgtgcaatgatctcctgtaagttaattacaatatgagatgccattgtgatcgggtctgttcctttttccggagtagatccatgacagccagttccttttacatggatcacaaatctgtcgaatgatgccatacaacatccaggagtaataatgacctttcctgccgggatatctttgttgatgatacttccaatatgctgtccaaatacagcgtctacaccatccattgcgccatctttgatcataatctctgcacctttggataattcttctgctgtctggaacagaagtcttacatttcctttaatttctgctttatgtgcattcaaaacttttgcggctccaagaagcattgcaatatgattgtcatgtccacaggcatgcatcagaccttcatgtttggacttataatcgacatcatttgcctccgtaatcttaagtgcatccatatctgcacgaagtgcaaccgtcttacctggctgcccacccttgatttctgcaatgatactgctgtctgttcctgaacatttataaggaattccgagttcatccagtttatctgttacatatttctgcgtttccggaagatcaagaccaaattccggaatctgatgcagttctcttcgcatttttacgagttcttcctgtaaaccttcacattctttccacatactcatgcttattccctcttttctctatgaatcttttgctttttattcatttcccgctaagcagttttcttttcttttacatataacagtcttgcaaatccaaggcttccgaatacagacacaacgataagtacccatgccggaggagcaatcgtaaatttaaggataagcggaagtcccatgccaaagatggcaactttaggatatttcaatgcataggttccaaaagttcctccaaaaattgcacctgctgcatattttgtaagagcggatacaataacatctggaagtacggatacaactgctgatcctactaaaacagctgctgttgtagcaatcaggtttgtaataatagaaccacagattgccattgtagaagccacctctgcctgaagcgttcctggttcactctccgtcgtttcaagagccattgttgcacatggaactcgcatgttaccgatatttcctgaaaggaaacttaagtatgtaccagtaagtccaagagctgcatagtaagaaattggttcaacaacatagaatgcaccaaatgataatgcaaccattccccatcctgcaagtactactttcggatccggccagcagttataggtaatacacagccagataaccggtataaatgatgtaaatgctgcgagcaggtttgtaggagtaccgattctaatactattctttttccattctgacattaattctttattttccataatcataccctcctatgctccaactgccatatcatagatgattgcaaataacattccgatgatcattgcaataccaagattgtactctctgatttttggaactttctttgctacaaatttttcaaggattgccattccgataataccaccggcaacggctgctgcatttccccatcctttaccaatttcgttgacatccagataaccgaagataccaagtgaacaggccccactcattacaaccagccattttgaatcgccacgctcatctttgttcttaagttttcaagtgcaggtgtaaaaaggcctgttacaaccagccatccggctccgttgagtgccattacgaaccagctgacagccataactttcagtgtaaatccagctcctccaagctctgcgcctgccgcttcagcaccaagcgttgctgcagtaagctctgtcggtgctgcaccaatgatggaaagtctctgccatgccattggacctccgatcgaagtcataagaccaaccattacgataaatacaccaagtgcaggtccgattgcggaaatgagaccgactctgaatgctgtcttcggcactgttgccggaatgtttgccttcactgtcattttctttgccattcggatataaagaacagcctggataaatgcaattgctacagtaataccacaaagcaaatacactatcattgaattagaaatctctacataatccatatactctcttcctttcttctttcatgttccttttttgttatccagtttcctcttgttgatgataagtttacaacttaataactttgctttctatatatatcatgtacaaatttatcttgatttttttatattcgacatcatttttttgtatttgtgatataattattttatcagtttttgtatttgagatacaattttattacaaggagactaaaaatgactgtcgaagaactattacaactgccaactattaagggattaaaacttatttccggaaatctcggtgtacacagagaaatctccacagtaaccgtcgttgatactccggatggcttccagtggttaaaaggaaatgaagttgtgatcacaacgacctatgccctggaaaagacgcctaatgcttttcttgatttcatcagcaagctgttgtcaagaaatatcagtgcactgattgtcaaatcggaccggtacataaaggttattccggaaaatgccaaaaaactttgtgatgaaaaagctttgccactgatctactgtccggcaatctacgcatttaccgacattatcaatccaactctgtccggaattatatccaaacaggcggagcagctaaaagaatcttccaagattcacgagagtttcctggaactggcaataaatgaccgctctatccatcaaattttgcagacactgagtactctgatccaggaaccgactgcctatgttgatactgttttccacaaagtatatttttctgaaaatgtaagcgaggatagtctttatctgaagggattatcatatgaaattattttaaataaataccgagagaaatatcagtgtatcgacgttgtcaataaagagcagaaatttggatatattatgcttctttctgaccgttctgaccggacatatccggatactgactccaatatctacaaaacagcgattgaatatgccagtatcgtaattatcctgcgtatgcagatccgaatcagtaaccggatgatcgaagagaaatattactcttcttttgtaggtgatctaatgcttaacaacgtcaaaacacgtgaagagatcaatacacgtgcccatttatacggctggaatctggacggcggcggatttgttgcgatcatcgatataaacaatattaaaaagtattatctgcgtaatctggataccggaacaaatgaaaagcttcagaaatatacagaccagatttttgatacttctattaagtatatcaagcaggcattcccttccactatttattattcacagagtgactttattgcctttctgatcactggaaaactgcctgtcagcgcccgtaaaacccttgcagatacattcagtcaaatccagcacagtctgttgaacgccgttccttttactatttcaatgggagttggaatgtatgtagatgacattatcaatattcacaacagctaccaacaggcaaagcaggtcatccagactgtctatcagattcagcaatttaaccgtctgttcttttatgatcagattggaatctatcgcttattattttctatttcatccaataacgaggcaattgaattctgcgataaatatgtaaagcctctgcagcaatacgatgaccagcatcatgcaaacctgattgaaacactacagtctatcatcaactgtggatggaatttaaagctggcatctgaaaagctttttttacattataattctgtgaaatatcggtttcagaaaatttgtgatttacttgaaattgatttgagagataattccagacatacggaaatagaacttgctcttaagatttatttgattcagaaaaatcagatatagcgtgggatttttcgactgactcattcaatcgcgggatttcgccttataaataagcgaaaaaatacagggaagaatgcaagcactcttccctgatattatttacttatttgcacggctcaatgccatcacgaatattactcgatgattgtagcaacacgtcctgatcctacagtacgtccaccttcacgatatcagactggtatattacagtgtgcaaatagtgatttttcgtgtgattgatggggaaaaatccggattttccgttgtgtccgtatggttttggtggattttgttatcatggtgttatcacactgcttttcttccaaatgtactaatctttctcatcaaaaattttatttattctcttcatttttatttatacaatttattccattaactcaaatctatacttctgtaacacatctggatacttttcgtgatcaacttccgaagcaaacatgtcataaggtctgatataaatctcatgttttccatacaaagcttcgtatacaacatacttctctcccgtttccgaatgtgtcgctattgcaattatcaaatactccttatttttaaaatgcctataccttttacctactttaatttgtctcatttttttcctttccaagcatttttaataattctgaaataaataaatataggaaaattcccaaacaaatcaataataatactatcgtaatccctactgtactccaaatgttctgagtttgaaaacttcctttaaaaaagccaataatatccgtaaattggtttactaataagcctacaaaaaaagcaacaatcaatccatcaattgctaattttttaaactctttaattcgttttattcctgctttcttttcaataagttcagatgcatcttttactgcatcatctctaacttcttttcgaacttcagcataaattctatcagttaactgcatttttatagcttttacatatgcttctttgtcctcaggtactgcgttatctctaaatacaacatcatcctgtaagtctatatatttatcaatcaatgtttccaaagtttctgacatttatttttccttttttaacagtaaatttacagtatccaaaaccttttcatcaaattcatcagatatttttgccccaataaatttttcttcattttgatatattgcattctgtttatttttataaagtttatcatcagaaggctttgattttaattcttcaaataccatttgtgcaattctaattcctggaaaaatctttattgcataatcggtggcattaaataaaccaattttcaatttaccgctgtatgtagaattacaatgttggtcacttataagcaatcctaatctagtaaatctagttcttggtctgatatgtgctgtaatattatctggaagattaattttctcatttaatgatactaaaagatattctttcggagaaatcgtataccccgctatagacaaatcaatttcctcatacatgttatctatatcatcctgatcatataaactgatacatttaacttctttttttaaaacagctatatctgtccctatcgccaaatcataagattcactttgtagtgcttcttcagaaaatggaaaaattaatgatttatcattttttttagcttttgtatccatacataattttcttatttctttatctgttaaaatcataatcttcaccttcaatcaataatataaatataataatacacttttcttttaaatacaatgtctatgcctaaaatacattttaataaatgttacgatatctatttattatatgaatacatcaacatgcattccactcttcacccatcctaaacatatacagcaaattgaaaatcacattatataaacattttcaaacgtactttcaatacccctgtgtatgtatttctacaaatatattgcaataggaataatcaacaacgctggtccctgcacatttgtttctaatgcaccaatattcatatcatgattactatctgcattaaaaccagatagcatttcttcaagcagactttctttaaatatacttagacttgtatttcgaagtaaatctattttttcatcttgatcacacactttagcaactttacctaaaatcttaaattttccatctactatttcgctactatttccattaaaaaaataatccatatatactggtaatactgccttaatcccattcatttcattcatctcacaaatcatatccaccattccattcgccttaaggctattggtaaacgcttccatttgtgtaatggtctttttatcctctaaattcttttgttttgctttttttccagtaccatcattttgcataactgttgcaagctctaacaccctcgtcatattctccatcattcttattaaaggattaatttttaatatcccagatatttcaataaactcacctggctgaatattatctatttttccctctatacgttttactagtttttccttaaacaattgtcctttaaggttattaaacaatgatgatggtgtatgtatcttttcttgctcttgttccttattatgttctctactatgattaatatcagtttttccctttaattttactccaagtaatgcaaaaatatttttattccctaaatctgcttctatcattccacctaaattgctttctgcagctgatgctgttttcaattttgttacttgagtaaatccatcatttattgatgctaacaaatcaaatacaattttttgatttaaatacaaagggatttctaaactatgcttattcaaatatttatcctccgtttatctcggtcccataaatttgtcaccattcaaatgtatcatatgctccggcatttcagctatccatacttctgtatcccatgccaactcttccgaaaactttttatacgttttaaaatccagaaatgccgtaacaaatattttcccagcagttacatcttttgtcatttctgtaatttccagaatacgttttggatccattggacctactgaagtaactgattcaataaagtaaatccaattcttatcttccctatataatacaacatctggcattttatcatgcagtgtaatctcaaagcccaattccttcaatttatctgtatttttcactaaatttttttcaatcgtatctcccacatatagacactctgcattctcagcgaatctcggtgcaaactcttctataattgctttctgtagttcgttatgttttcccggtgaaaacttaaaatcatccccatttattttcacaggcatcattttcatttcctttttcgatgcataaatgtcaactaatctttcatggtacatcatgtatctagaagatatttcattccaaccaacactctgatagtgttttaatagttccaatgtttcatctgtcaatcgataacgataattcggactattcgtcgcttttccattatcttctactaatgcagctgttctaaatctatgcaaagcctgttttctaattgcttctctactattctctgcataactagtttcgtaattaagatttgcaaactgaataatatcatgaatcctaatccaatcttttgttgcatttctccatgacatatccggttttattccagccattgctaataaaacataacaacatatgtctgcctgctgtgcttttggcattcctacaaatttcaatatttcgcgtgcttcttcaatcttatccacagtacccctccaatattatattgcaattcttttctgacatatctttgcttttcattatttttcttcccatttcctgaataatattaatatccggaaccggcattgcattaatttcagttgaattaacctgcgttgaaccattcagaatccggtaatattcatcataaatcgttgaattaaacagcacatacaaaccatataccaagcattcagacatatttgtaagcaacccatcaataaaattaatcttattttgtgtacttatctttgaatactgcggaaattttttcgacaaatataccccacattgcaaccttctcggttcttccttagcggtaaatctctttacaaacaaatagttgtgattatcctgcattaaacctttttgctctgtcacaacatattcatgttccttttgaataggaaactgaactataccttcttttatatgttgtgaataaaataaacggctgtatttgatatcaataagctgaagtggatgaacggggaatatctgaaggctatggattttgataaattctatgaacttgcagagccgtatatcaagaaagtgatcacaaaggattatgatctgaaaaaggttgcgtctctgatcaagagccgtatcgaaatccttccggatatcaaagaccagattgatttctttgaagctgttccggaatatgatactgcaatgtattgccataagaagatgaagactaacgaagagacttctctggaagtattaaaagaaattcttccaagactggaagcatgggatgattacagtaatgacgcattattcgggctgctgaagggatttgcagaagaaaaaggttataagaacggatatgtgatgtggccggtaagaactgcagtttcaggaaagcagaatactccgggtggagcgactgagatcatggaagttcttggtaaggcagaatctgtagaaagaatcaagaatgcaatagaattattaagcagataatatacagatataaaagtatgcatgggggacggatttcttttttcgcgtaatgcggaagaggaatccgttctgttgtattacatatgagaaggggagttcatgaaactaaacagaggacaggatgaagcgataaagcacggaaatggaccgtgtatggtgctggcacctccgggttcgggaaagacgcttattgtcacagaacgtacccgttatctgatcgaggagagcggagtacgcccggatcagattcttgtaattacttttacaagatatgcagcacgtgaaatgaaagaacgttttgaaaggctgactgccggaaaaaattatccggtaacgtttgggacctttcacagtattttttatgggattctaaaatgtgcctatgggattggtgcgaataatctgatgtctgaaaaagagtcctctgtacttttacaggaggtcttagaccagaccgatatcgaatcaacacctgaggtagaagatgaagaggaactggtgagagaacttctgcgggaagtcggcatggtaaagaacggactttgtcatctgaaagattttcacagtaagtatcttacacaagatgagtttgcagaagtgttccgcagctatgagcatcagaaaaaagaactgaaaaaatttgattttgatgatatgttggtacagtgttatgcacttttccggaaaaagccggagattctgcaaggatggcagaagcgtttccagtatatcctgatcgatgaattccaggatatcaaccgtgtgcagtatgaagtaatccggatgcttgcagcaccgaggtacaatttgtttgtagttggggatgatgatcagtccatttatggatttcgtggagcaaagccggagctgatgctttatatgaagcaggaattcccgtcacttcggaccatttcgctgacggtgaattatcgttctaccgaatttattaccggagcagcggcaagagtgattttgcataatgatacccgtttttacaagcgtgtacagttatttcggggaagaggacagaatgttcatgtgcaggaagtcctggatgaacaggaagaggcgcagtatgtaacggaagagatccagaaaaaactggaccagggaataaagccgggagaaattgctgtacttttccgggcagcagtccaggcgcgaatgatttcggaaatattaagcgaacaccgtatcccgtttgaaatgcgagattatgtgaccaatttttacaggcattttattgtaaaagatatgatggcatatctgcagttggcagcaggaaagcgggacaggtcgcttttcctgacgatctgtaaccgaccgctcaggtatctggcacggaacagtatggagaaccggcaggtaaattttgaggatttgcgtaaattttattgcgataaggactggatgctggatattattgaccagtttgatgtggatgtccgtatgatgaagaatatggcaccatatgcggcaatccagtatatccggaaaaagatcggatatgatgatttcctgaaagaatatgccgaaaaacatcagatttcgtggaaacagctgatggatgtgatggcagagcttgaggagaggagtaaaaacttcaaatcctatgatgaatgggaaatccatattgcaaaatatacgcaggagctggaagaacagcaggcaaaggcaaggaagatcaaaggagagcgggagaataaggtacagctgatgacgatccattcagcgaaaggactggaatttgaggatgtatttgtgatccatgccaatgagggtgagattccgcatcagaaggcagaaaagaaagacgagattgaagaagaaagaagacttttttatgtagcattaacccgtgcgaagaataatctctgtatttcctatattacacaaaaaaacgggaacagtatcaaaccgtcccgttttgtggaagagcttttaggtcagagaataaaataattattcttcaatatcaaagccttcaaattcctgtgtatcaagccattcatcaaacttatccgcagcgcggtcatactcatcatcatcttcgatattctgaagatcatgatcggagccgcctgtggtatcacggataaagcgatagatccatacgtctccgtcctcatttccaccgtcttcatcaagcggaagaagtgcaatgtattcggtagaatccatattaaaagttgtgataatggcgcattcgatttccacatcgtcatcaagtgtcagtgtgacaacatcggattcaagcagattatgttccttttccattgttcagttctcctttcaatctgatactatcactctaacagagtatggggatatttgcaaggggaaaagtattgacattagcggtaaaaaagatacaataaaagaaaggtttcagggaggtttatctatatgaagaaaaagattttttctatctttcttgtgatggttctctgtattggcatgactgcaggctgtaagaagaatgttgggacaagccaggacaatgcaatagcagaagaggacgatgacagcaaggaagaggcaaaaagctatcgttttggatttagttgtattaccatggaaaatccatactatattacacttgagcaggcactgagagaagcagtcgaagcacagggaagtacgctggtgacaaaagatccggcactgaatgtagacacccagatcgagcagatccatcagatgatcaaagacggactggatgccatttttctgtgtccggtatcaagagatgcgatcacacctgctctggaagagcttaaggaagccgatgttaagatcatcaatattgatacggaagttaaggatacggattatattgatgcctttattggttcggataataaagctgccggacagctttgtggagaagatctgatacagcagagtccggatggtggaaagattgtaattcttgaaggtcttacacagaattctattgtagagagaattacaggctttgaggaagcaattgccggaaagggatttgagattgtaggaagagcagatgtcagtggagatttgaacgaggcaagagaagcagctaacaagatttttgcagagaataaggatgttacggcagtaatgtgcgggaacgatcagattgcgcttggggcactagttgcagcaagaacagccggtcttactgatgtaaagatttacggggtagatggttctccggatctgaaaaaagaacttcagaagacggattccctgattcgcggaacaagtgcgcaatcaccgatcaaactcggaaaagaatcggccaaaatcggttttgctattttaaacggggatgagtatgaaaagacaacgtatctggatgtatgttttattgatgcctcgaatgtagatatgtatggagttgacggatggcagtaacagggggaacagtggatatgaagacagcagtgggatttccgtttccacagggatgtactgtggaaggacagacagcgaatttttcggtagcagttccggaaggacagacatgtgaactgatcatttataaaaaaggtgccagggcttcagcattttcacaggagatgccatactctgatgtggcaggaaatctgcactttctctccgtggtgctggaacaaccggaagattatgaatattgttataaaatcggtggaaagatagttccggatccatatggaaaagcattttcaggcagagaacactggtctgtgtcaaagggaaaggaaaagagaacactgcgtacccggatcgtaacagatacatttgactggggaaagtcgcaatttccgcatctgaaaaaggaagatgtgatcgcctacagtcttcatgtccgtggatttacaaaacacagttcgtccggagtcgcacacaaaggaacgtttgacggagttacggagaaactgccctatcttcaaaaattggggattaaccagatccatctgatgccggtttatgaatttgatgagaatcagaggcatgtgaattactggggatatggaaaagcatatttctttgcaccaaaagcatcatatgcggcaggagatccggtgaatgagatgaagttacttgttcgtcagatgcatcttgcaggaattgaagttattcttgagatgcctttcacagagggaactacgttttctctgattttagattgtctgcgttactgggtgatgcagtatcatgtggatggatttattgtgaatccatatatctgcaatccggatgaacttgcaaaggatcctgtgcttgcgaaaagtaagatcctcaaaaaagaagacggattccagaatgtgatgcgccgtttcttaaagggagacgagggcatgatccgggatgtgatctgccagctgaagaatcaggatacacagctgtataattatattgcaagccacaacggatttacgctctgtgatgtagtttcctatgatggaaagcacaacgaagcaaatggtgagaataatctggatggtccggattacaattacagctggaactgtggggcagaagggtacagccggaaaaaggcggttaacgagttgcggaagaatcagatatttaatgcgttctttttacttttatttgcacagggaatgccgtgtatcctttccggggatgaatttatgaatacccagaaagggaataataatgcatactgtcaggataatctgatatcatggcttgactggaaccagctttccagacaggaagaattatatacatttgtatgtcgactgattgcacttcgcaaagcctgcatgaagcagatagcgaaaaaatcagaagacacgatgggcagaagcggaatccctcagatttcctatcatggggaggatgcgtggcaaatgccggcagggcgtgcaagcagacagcttggtgtattctatcatgaagaaagtacagagaaggacttttatattgcatataatatgcactggctttctcattcatttgcacttccttcccttccaaaaggaatggaatgggtgtgcatagcagggacaaaagaaggagtcctggatgaaaaagaagcagttccggtaaaagataagaaggttcagctggaggagcgaacgatcaaagtttttgttggaaggcaggctaaagaatgaaaatctggaaacatttttgcaccataacacatcacaaatatctggttatgaagaactgctttaaggtaggactttacagacagggacttttgcatgatatgtcgaagtactctccggcggagttctgggttgggtgcaggtatttccagggaaaccggagcccgaataacgcagaaagagaagaaaagggctattcttcggcatggctacatcataaagggcgcaataaacatcattatgaatactggattgactacggactggaaggggaaccaatgcttaccgggatgaagatgcccaaaaagtatgtggtcgagatgttaatggaccggatcgcagcatccaagatttatatgaaagataaatatacggatacgtcaccgcttgaatattatcttcacggtattgcaggggactggatgcataaggataccagggcacttctggaagaacttctctatatgctcgcggcagacggggaagagaaaacttttgattatatccgaaataccgtgttgaaaacgagagattattagaaaaagaggataaaaacatggcagatttaccaaaggatccaatgatccttctgagtgtggtcaatacaaaattacgggatttttatacagatctggatactctttgccaggagatgcagattgagaaaaaagaactgacagagaaactggcatccattgattataaatatgatgcagagctgaaccagtttgtatagagaggttaataacatatgaataatattgattttgatgcaatagatcttaccaaagaagctccggtcactgagccggagagacagtactattacattgccaaagcgcggaagtatgtaagcgaaaaagcacaggagatcggaagaaatctgacgttttgcgtgacgactttcggttgtcagatgaacgctcgtgactccgaaaagctggtcggtgttctggaactgatcggatacaaggaagagccggatgaagagaaagcagacttcgttatctacaacacctgtactgtccgtgaaaatgcgaatctgcgtgtttacggacgtctgggacagcttggtgcaaagaagaaaaagaatccgcatatgttcatcggactctgtggatgtatgatgcaggaaccgactgttgtagagaagatcaagaagagctatcggtttgttgacctgatctttggaactcacaatatttataaatttgcagaactgattgtgacaagatttgaatctgagagaatggtgatcgatatctggaaggataccgataagattgtggaggatcttccgagcgaacgtaaattttccttcaaatccggtgttaacatcatgttcggatgtaacaatttctgcagctactgtatcgtaccgtatgtgcgtggacgtgagagaagccgtaatccaaaagatatcattcgcgagattgaaggacttgtggcagatggtgtggtagaagttatgctccttggtcagaatgtaaactcttatggaaagaatctggaagagccgatgacatttgcacagcttcttcaggagattgagaagattgaaggactggagagaatccgctttatgacttcccatccaaaggatttatcagatgaactgattgatgtaatggcacattccaagaaaatctgcaagcatctgcatcttccggttcagtcaggaagcagcaggatcctgcagaagatgaaccgccattacaccaaggagcattatcttgaggtggtaagaaagatccgcgaagcagtgccggatatttcccttacaacggatattatcgtcggattccctggggagacagaggaagatttccaggatactctggatattgtaagacaggtgcgttatgacagtgcctttacttttatctattccaagagaacaggaacccctgcggcagcaatggaagatcaggttcctgacgacgtggtaaaagatcgttttgatcgccttttaaaagaggtgcagcagatttcagcggaagtatgctctgtacatcagggaaccacacaggatgtgctggtagaaagtgtcaacgatcatgatccgtcattggtgacaggacgaatgagcaacaacctcctggtacatttcccaggagatgaaagcatgatcggtaagatcgtgacagtttacttaaaagaggcaaaaggcttctattatatgggagaactctgtaaataaatccaatgatttgtgataaaatccaaaagaaacgctcatgctatgtaagagatttgcatagtgagggcgttttttatggtgaaaagagtgagtaaaagggtaagtgagatagtctttctgatagcagcagggggaagcacctattatctgatcgagatctggtttcgtggattttctcattggaccatgtttgtgcttgggggagttgcattgacattttgcagttttcagggcgaggtaatgcactggtctgagccgatgtggattcagattatccgggcagtgcttttcctgacatccctggaatttatgacggggattatctgtaataaatggctgaagatcgggatctgggattaccgggatcagccgttccagctgtgtggccagatctgcctgccatttatggtgatgttttcaggacttttatgccttgcgattgtgcttggaggagtggtgctctggggcgtatatggggaggaaaagccggagtttcatgtgttgtaaaagggacttaagcattttttatatatgaaaaatgacgaaattaagatgaaaagagtcgtgggaaaccaaactcttttcatctttttttgtggatggttacaaaaatgagtataaatgtattttgttaaatgtaaaatgttgacaattcatgaaaaattcagtaagatacaagaaaggttcaagataaaaaacaagtgaatataatcatggacaaaggagggcggcaggaaaaataggggaaaatataaactgttttttattgaatgagaagtatatgttatttggaggaaaactaaaaatgaatcaatatgatgaagccttaaaaaaggagaccgcgtttttgggccagcctaggggggtggggactctcagctttgtacagctttgttcgtctttttcaaactacgcaatgaatgccgtaatgatctattacctgtatgcaaatgcacctgcaggtcttggattcgataaagcggatgcagcacagttgatttctttatatgcaactgtagtcggaatgacaaccatcatcggaagctatgtctgcgaccgtattcttggatgtcgtaggtcactgcttgtagccagagttaccggatttatcggttataccttgcttgcatttccacttggggtagtaggatatgcagttgctatgggatgtatggtattcggttcactcttcgcaggaagatgtatcgaaactctgatcggtaaattctacgatgagaacgatggaagacgtgacagtgctttcacaatttcttacgtaatttccaatatcggtgcagcagctccggcccttgcaggtgtaatcgcagcgaaatgcggatatcacgcagcattcgcattatcagcagttctctcattcttaggtactgttgcttatattgctacttacaaaaaattcttcggaaatatcggtctggaaccggatgatccgcttccggcagaaaagaaacgttcttttgttgtaaaaatgcttattgttgttgctatcgtaggaacagttttagcagtttcatttgcaacaggaaagctgaaaatatcttcctttgcaaacgtagtaagtactatttccatctttatcccgcttgcttatcttgtcttcatctattccagcaagaagacagaaaagcacgagaaaaagaaagtactttgtctgcttccaccatttatctgtaacgccgttacacttttgatctggacacagacaatttcaatccttgctatcttctatgaagaaaaagtaaaccgtgtgatcttcggagtagaaattccggcagcttcattccagacaatcccggcaatctttgcggtttgcttcggtagttttcttaccatgctttggacaaaacttggcaagaaacagccattcggaacaacgaagatgggattcggaacgattttgtggggacttggagcaatgatcattgcactcctttatatcatctacccaggcgatgcaaaagtaaatgcatggtggatcgtattgttctatgcagtactgatgtttgctgaaggatttacatgcccgatcggttactccattacagcagtagcagcaccaaaagcctttgtaacacagatgatgactgtatggtcaatgtctcagtcagtaggagctgctcttaacatgatcctcgttaacttctataaagaaggaagcgaagtgccgttcttcatcggaatcggtgcagttgtagctatccttggtgcagtcgtactcgctttcagcaagaagcttgcagaaggaatgggaatggaaagagaagcgtaggaagtttctcaagaataaatctaataaatgtcctcttaaagaagaagtagtaaaagtatcaaaaaaatccttgtcaggcagagatgtccggcaaggactttttgattctataacattttgtaatattttgtaataaaggaggaaagtgaggtggacagatttaaaagaatgctgcgattattacaatataaactataaatccctatgtacttatatgcagaaaaataaaatatcaaaagagggggcactcagccattattatcagtattataaatataatcgttttacatataaccatgtgacttatgacagtttcgccgcatgctgcatggcatatgagattaaaccgatctgcgttcggcgatatgcaaaaagaaagcattttctgctgcggcatgcgctttccagctatttgaattatcataataaaagaaaaatatatttctgcggacaggaatatattacatttacatcatgttgcagagcatttggatgcaatgcatcttatgtgtcggcatacgcaaaacggcacggaatatccagagaagaagctttgaaattttatatcaatcgtattgaaaagcaggaaggacaaaaaatagattccagaacatttgtattccgggatagtatttatcatgatttgagtgactgctgccgcaatcttggtataaatgtcagcagcgtttatggttacatgtggagaacaaaaaagagtagggtagaggcggttgaatattattatacaaaaaatgcagaggaacagtttgaatgggagtccgttttatatccatctttatcggtatgttgtacgaaatttaatgtgtcataaaaagcggtgcgcaataaagcatggcgaaagaattgttcggcacaagaagcattccggcattgtttgaaaaggaagaagaatctggaaatggacgcgttttactataaaggtgataggtataaggacttgaaagaatgctgcaagcaatatggaatcaatgttcaatctgtgcattcttataggttccggaataaagacagcgattatgatgaggcgattgattatattagaaagattacgaaacagcggcaatttatttgggaggatggaagtgtatatgaatcaatcaattccctttgtagaatgaaaagtatctctgtaagcagtgtgagagataaagcgagaaagaaagggatgtctttacaggaagcggcaaaatattatattgagagaaatagttatgactgatgagtacgcagtataagcggatggtagaatttatgagaaatgtgttgctgtttattgcaattgtgataaaattaggataaaataaagatagtaaaatgcgaaaggagaggtggaaatgatacaaattcgcccagtttctgatcttagaaataaatttcctgaaattgagactcttgttaatagtgggaatcctgtgtatttaactaaaaatggatatggcgctatggttgttctaagcttagaagagtatgcaagtctcacagataatattgaaatgaagcttgatgaagctgacaggcaggctgcgggaaccgatgaaagactttctcacgaaagcgtgttcaaaaatgcaaggagtgcaatacatggaaaataaatcttatcagcttcgctacttgccaatatttgaaactgatttgctaagtacggtaaattacattacaaatgtcttgaaaaatgaagatgcagcacatcggttggttgatgatattgaaagtgccatattgaaaaggctggaaaatcctcttgcgtttgaaccttatcgttctgcaaaaaggagagagtatccatattatcggatttatgtgaggaattatgtggtatattatgtggttatcgggaatgttagggaagtaaggcgactgatatataaaagcacttgataaggaactgtaagttacgatgttaaaaagtagaagttactgatgatggaacgccggatgaggggaaactctcatgtccggtgtgaagtgggggaaagtctggcgataacatcaaaggattatctatcactataggaccgtttgattgccctgcatcatttggatattggttggaaaccatctgacttggaacgtgcgcccgtaaaggcatcataataaatatacctttggcaaggtattaggatagtatcttacagtcctatcatcaacaattaattataccaaaaaatcgctcagacctcacggtctgggcgatttttctgtcaggggagtttttttacagcccctttgtattctgttctgtgaatgaatcgaacgcacatccacagggacaggatttagaaaaatacatttcccccaacgttgatcccggacattccggtacttgcgcttcgaaactggtaacatccgcttacggatgcaagtcgtgcacctccgagcgcttcctgagcgacctgatagcataaggatacaggtccgctttgcaggacgcggcttaagcttccgtcccaggttggagcaaactgtccgctctggtagacgacaccgcttatagtgttcggatatgcaggactttccacacggttcataatgaccgttgcaacggcgagaataccgtcatagttgtatccgccggcttcgcactgcaggattgcagcaaaaagaaccaggtcggttgttgcagcaggtgtatccggaactgtaatcgtcgtattgccgccggaactaccggaatccgtgttcccggagctgcttgaagtattattggcagcagtctgtgcagcttctgcctgtcgttgttgttcagcagcttcttcttcctgttttttcttaagtgcggcagcagcggctgcctgtgcttcttttgcttttgccagtgcttcggatgaagcctgaagttcaccggaagtagaggaaatcttatcattcagttcctgttcctgttggtcgagatttgttttcatctctgccagagaagcctgctctgctttcagatcagagtcctttttagcgacaagctcgtgaaccttctgtaattcatccagcatatttctgtcgtattctgtaatgttcttgacaaattctgctttgtttaagaaatctcccatgctttcagaagaaaagatgatctgcaagagtgacgtatttcctgtttcgtacatatatttgattcttttcttcatagcatcatactgtaactgctcgtccagttttgcggcggcaagatccagttctgctttctgtacggaagcatccgtatcctcaatttttgatgcaagatctgtgatctcagcgctgagacttgtgaggtcctgattcagagagtcgagctggttctgaagaccgtttgtctgcttttcgagagagtctacagtgtcatcggcgtaagcttttgtaaacggggagcagaccagggcagcggtaaggagtgcgatggttgtccttgaaaatgcttttaaccttttcttcataattcttcctttcttcaaaattgagcctttatcagtatactacaaaatgcctgaatccgcaaattttgttatacatacacggggaatcgtgttatactaagatttgaaatgtatttttagctttaccataaatgagggaattattcatgaaaaagataaaaatgatagggcttgatctggatggtactttactgaatgataagaaagaactgaccagtcatacaagagaaatacttacacgtgcgatcgatcagggagtaacagtactggttgcaacagggcgtccggtgacagggataccggaagtgctccggaatttcccggggatgaggtacgcactgacatcgaacggcggaaggatcctggatttacaggaagacaaagtactttatgccaatatgctctcttatgagattggagcagcgatccttaagatttttggagattatgatacgttcaaggagatctattttgatggaagaggtttcgtacaggcagatgaacttttgaaagtcggagagtatctgcggaatcctgcgatggcagattatatccgaaccacccgcaaaggcattacgagtctctgggagaagatggaagagatgaatgggcatgagatggataagatccatgcactttttaagagccaggacgaacggctggaagcaaagcagcggatcatggagcttggggatttaagcatcagtgattcgatgggaacgaacctggagatcaatgcaccgggagtcaacaaaggaatgggactgattcagcttggcaggcttcttggaattgaacgagaagagatcatggcatgcggggatggcaacaatgacctgatgatgttaaaagaagtcggatttggtgttgcgatggcaaacggagcagatgaagtaaaagaggtggcagattatatcacattgtccaatgaggaggatggcgtggcggctgccattgaaaaatttgtattgaatcccgataggggatagaaagaggtcaaaatgttagatgttttaattgctgtcattctgggtatcgtggaaggtatcacagaatggcttccaatcagtagtacagggcatatgattctggtagagcagttcttacatatgagtacaagtcatgaattcaacagtatgttccgtgttgtgatccagctcggtgcaattatggcggtcgttgttctgtatttcaataagctgaatccgttttcaaagagaaaatcagcgaagcagaagagaaatacaatcaacctgtggtgcaaaatcgttgtggcttgtctgccggcagctgtgatcgggctgttatttgatgatatccttgacaagtatctttacaattatgtagttgttgcactgatgctgatcatttatggtatcttcttcattctgatcgagaaaaagaatgaacacaccagaccgcaggttacaaagctgacagagcttacctatcagatggcactgatcatcggaggcttccaggtcctggcactgatcccgggtacttcacgttcaggagcaaccatccttggagcactgctcatcggaacttcccgctatgtggcaacagaatttaccttctaccttgcgatcccggttatgttcggagcaagtatcttaaaggttatcaaattcggattccattataccgcgatcgaagtggtcattctgcttgtgggatgcctggtagcgttcttcgtatccgtatttgcaatcaagtttttgatgggatatatcaagaagcatgactttaaggcattcggctattaccgtattgtacttggagttctggtacttctttatttcctgattttcggctaaaagagaataatcacgaaaaaaggtgggaatttatgcagaaaaatgtataaaaacccactttgttttttctttataacatgatagaataggggaaatggataaaatttggaggttggtattatgaaaatgaaaaaagtaatcagtgttgtacttgcatgtgcatgtgtgttcagtttcgcagcatgtggatcaaagagtgattcatcaaagagtgactctgcaaaatcagacaagaaagaaaagcttgttatggctacaaacgcagaattcccaccatttgaatactatgacggagatgaagttgtcggaatcgatgcagaattcgcagcagcgatcgctgacaagcttggaatggatctgaagatcgaagatatggcatttgactctattatcccggctgttcagagcggaaaagcagatatcggagcagcaggtatgactgtaacagaagaccgtgctacacaggttgatttttctgacagctattatacaggagttcaggttatcattgtaacagatgacagtgatattacagaaccggatgatctgaaaggaaagaagattggtgttcagcagggaacaacaggggatatttattctacagatgatttcggtgatgataatgtagagcgtttcaacaaaggtatggaagctgtacaggctctgcagcagggcaagatcgatgcagtgatcattgataaccagccggctaagacattcgtagaagaaaatgaaggtctgaagatcctggagacttcttatgtagaagaagactatgcactggcaatcaaaaaaggtaatgatgatctggttaagaaagtcaatgatgcgatcaaagagttaaaagaagatggaacatttgataaaatcgttgcaaaatatattacagactaatcgggtacagactggtggtgtcttatgagtgattttaaagcaagatttataatgaattttataaaagatgacagatggcactacattgcagacggacttaaggttacattaattgtaaccttttgtgctgtcctgatcggtgtagttctcggattccttctggcaattgtccgttccacatatgataagaccggcaagctgaagctgctgaatctgatctgccagatttacatcacggtcatccgtggtacaccggttgttgtacagctgcttatcatttactttgtaatttttgcaagtgtggatgtcagtaagacaatcgtagcgattctggcatttggtatgaactccagtgcttatgttgctgagattttccgttccggtattatggcagttgataacggacagtttgaggcaggacgaagccttggatttaattatcgtcagacaatgatctatattatcatgccgcaggcgtttaaaaatgtccttccggcacttggaaacgaatttatcgttctcttaaaagagacttctgttgccggatatattgcccttcaggatctgacaaagggcggagatatcatccgaagcagaacctacgatgcgcttatgccgctgatggcagttgcgatcatttacctggttatggttatgatcttcagtaaactggtaagtatgctggaaaggaggctaaggaacagtgaccactaatggagatgtattgatccgtgtagaaaatctgcagaaagcatttggcgattttcatgcactgaatggaattacagaagagatccacaaaggagaagttgtggtaatcatcggaccgtcaggatccggaaaatctacattcctccgttccctgaaccttctggaggtaccgaccggaggtcatatttattttgaaggtgtggatattacagatgcaaaggtagatatcgacaaacatcgtcagaagatgggaatggtgttccagcactttaatcttttcccacataagacgattcttgaaaatatcacactggctccgatcaagctcctgaaaaaggataaagcagaggcagaaaaagaagcaagagtacttcttaagagggttggactggaagagaaggcagattcttatccgtcacagctttccggtggacagaagcagcggattgcgatcgtgcgttcccttgccatgaacccggatgtaatgctctttgatgagccgacatccgcactggacccggagatggttggagaggttctggagctgatgaaacagcttgcccaggaaggcatgaccatggttgttgttacacatgaaatgggatttgcaagagaggttgctgaccgtgtcatgtttgtggatgaaggaagagtaaaagagcagggaactccggaagagttctttgcaaatcctaaggatgagcgattaaaggaattcctgtcaaaggttctgtaaaaataaagaaatataaaagaaaaaagttctgttttcttaagagacagaacttttttctttaagaattgcgaaagactattgctatttttttatttatgtatagtatagattgtatgaagaaaataaaaactataattccacttattattacattttgtatgaatgctgtggtatattggggagtgccgctattacggacgggaatcaagactcataatctttctggtccggcggatgaagtgattccttttatgccacagtttattattatttattttgggtgttatcttttctgggtagtgaactatttcatggcatcgatgcgggaggagaaggtgaaataccagttttttactgcggatttttatgcgcggctggtatgtatgctgtgctttattttttatccgaccacgaatacgaggccggttctgacagggacggatatctggacgcaggcagtacggtttctgtatacagttgataagccaatcaacctgtttccgtccattcactgcatggcaagctggttcagttgtattgcggtcaggaagaatcggaagatttccaactggtataaagctttttctgtcctgatgacggtactggtcgtgatatcgacactggcgcttaggcagcatgtatggcaggatgcagcagcaggaattcttcttgcagaagtaacctggcagatcagcagacggacaaatggatggcagatttatcggcgtctgacagaaaaaatagcaaataaacttggaaaccggataggaatgaggagagatggaaaataaaaagaagacgatcttcaatgtcatatttttgctggtggtatttgccggtacaatgtatggcgtatttcatggggaagatattggtgagattgtgaagatcctggaacaggtcaatgtattatggctgattccgggagtgatctgtgttgtggtttttatctggggagaatcgatcattatctattatatgatgcggacactgaaaatccggctgaaaaaatggacatgttttctgttttcatcggttggattcttcttcagctgtatcacaccttcggcatctggaggacagccggcacagatttattatatgaaaaaagaaaagataccaataccggtttcgacgctggtgctgatgatcgttacgatcacttataaactggtactggtggttgtcggattgtggctggtactgttcggacagggatttatccataaatatctctggagtatccggcatattttttatctggggacagctctgaatgttttttgcgtgacagcgatgctggtgctggtgttccatccgcggcttgcaagagaaattctggtcaaaggaatggcactgcttgaaaagctgcactttctacaccataaggaggcgcgtattgaaaagctgaatgcatcaatggatcagtaccgggatacagcagtttttctgaaggaacacaagcaggtgatcgtgaatgtatttgcgattaccatgttccagcggtttgcgctgtttacagctacatggtttgtatataaggcatttgggcttggaggtgcaaaagcagtcgcagtcattacactgcaggcggtcattgcggtatcggtagatatgcttcctctgccgggaggtatgggaatcagtgaaaaattatttgccatgatttttattccggtattcggaaaacggcttcttttgccgggaatgatcctgagccgtgggattggatattatacagagctggggctgagcgccttgcttacgatcgtagcaaattttacaattggaagaaagagggagatagaatgttagggggttatgattatacggtagtacttacatatgtcagtttgatggtatcaattggaggaatgatgtttgcagtaaacgggcatctgcatctgggcgtgatgtgtcttgcaatctccggtctttgtgatatgtttgatggaaagattgcaagaacaaaaaagaaccggacagaagtggaaaagcgtttcggaatccagattgattcgttaagcgatattgtttgcttcggagttgcgccggctgttctttgttactgtttcggaatgcgcggtgtgatcggtgtggcaatcctgatgttttatgtacttgcaggtctgatccgtcttgcgtggttcaatgtgatggaagaacagcgtcaggaagaaacagcagagaaaagagaatgttatcaggggctcccgatcacatccatggcaatcgcacttccgcttgtggttgtattaaaaccatttttaggttgtgaatttatgcttgcaatgcatgttgtgatgctggtagtcggcattttatttattacaaattttaagttcaggaagccaaagaatctaacaatgggagcaattgtagtaatcgtagcaatggcagtaattggcatcctggtcagacattatatgcgttatatgagtatgatttagcaggcagacggtcagcggcagaggaggaatgaaatgtattacatggacagagaaggtcatcggataaaaaagacaaccagtcaggataagtttttaaaatttgtgtatacccatacagcaaccagagtactgatgcgcccgcttcttttaccggcagtatccagactgggagggaagctgttgaatacaaaagtgtccgctgtttttgccggactatttgccagaacacacgggatcgatctgaacaaatatgaaaaacagaaatttgattcctataatgatttctttaccagaaaaataaaagctgaggaacgcccggttaacagggaagataccgtactgatcagtccatgtgacgggaaagtgagtgtctatccaattcacgaaaacggacaattcttcattaaacatactccatatacaacacacagcctcattcgcgatgcaaagcttgccagacattatatgggaggctgggcggtagtaatccgtcttacagtagacgattaccatagatactgttacgtggcagatggagaaaagacctatcagagaaggattccgggaatttttcacactgtaaatccgattgcaaatgatatctgcccgatctacaaaatgaacagcagagaatactgtcttgtaaaaaatgaaaaactcggcaccgtcctgatgatggaagtcggtgcactgatggtcggaaagatctggaattataaaaaagaacgctgccaggtaaaacgcggcgaagaaaaaggaagatttgaattcggaggttcaacggttgtgctgctcctggaaccagataaagtctttccagacagtgatctgatccggaacacgttgcagggagcagaaaccattgtgaagatgggagaacgcatagggggagttatataggcttgctggttcaaaagggacgcgcagctgaatgtttccatcttgccggacaggcttgagacattaagggactctaaaattttgaaaagatgctaaaaacaggggaagaaatccacaaactcgctgtcgctcagacagtgtggatttcttcccctaacgcatcttctcaaaacctaagattccctaaaagtctcaaatgccgtcaagacggaaacattcagctgcgctgttcgtttcagaaaattatttagctgcaggctgctctcgcagccgtccagcgctcctcgggttacaggcgcactttctccattatgttctggagtcaccgtccctccatcattcaggagttgtctgtcttgaaaaaacagctccatataaagaattggactggtaacatttggaagaatattaccagtccaattctttatatggagcgtccccattttcactctacaacaacccctgcatcaccggcaaaggtgattccacaacgtaatctgccgcctttttggcgagagggtggccggttgccatgacatacgttgttcccgcagctttcagcatctcgatatcattctgttggtctccgaagcagatgcattcctcttttttgatcccgaatttttccattagaactttcagtgccgttcctttatttgcatttggcgcaataaaatcaatccagtgatccgcagaagttacaacgcggatttcatccccaatccttttgtggaagaagggttccagattctttgtgccaccaaaatcacagatggctgctttgatgatcggttctttaatcgcatacagatccggcacgtaggtaacgatgttatgcatatcattttccatataatcaatgaaacgttcatcggttgagtcgctgtaataagtatcttttacagaaaggatacagtgtccggtgtgatagatcttccggtattccatcagggcatccagaatatgccggatggttttggatggagtcagaccggtggcgagtatctcttctttatagacgcacatggaaccattttcagcgatatatggaatgtcgaagccgagaggagcgaaaagcctgcggatattggcatactggcgtccgcttgcggcagtgaagatgattcctttttcatgaagtgctttaatcgtatcatatatttctttcggcacagtctgctgatagttgtgaagcagagtgccgtccagatcacttgcaactaatttgatcataaatttcctcctgagtcaaaataacgatacgccggaaactatggcgcaaaactacattgacagtatagcaaaaatgagaagggcaggcaatgcagagctgaaaagagaaaaaacaaatgctaaaatttgagaaagcggataagcagaaggtgacgaaatgcagcaaagcggaaaaggtgtaaaacggacactgggacagaagacagaggatcgactgatgaaatatattctggataaaccggtaaaaataggagagaggatacctactgaaggtgaactgacagaattatttgaagttggacgaagtacggtaagagaggcggttaaagggctggtcacaagaggcgtgctggaagtgcgcagaggagacggaacttatgtcatcagtaccatttatatggaaaatgatgttctcgggtttggaaacgtggaggaccgttatcggttggcactggatctgtttgatgtacgtctgatgatcgaaccggagattgtaacctgggcgtgcagaaaagcaacggatatgatgagatggataggattgatgaataacattcgagcctgtgccgatgagattgtattgaatgatattgtgtattcctaacggataccaaccgaagaagaactgctgtcaaaccgatggcagtttttctttttcggcaagtattcaagaagtcattaagtcgtgagtataatcgaagtggtagaaaagttatctcttatatcggttgtaacttttttatgaactctattgacaagaaaacttggtatgtgtataattaaaatatgcaaagaaaacttggcatggaggtgtttttatgaaaaaggacgaaatcttaaatgcaagcagaaaagaacatcgcaataaggacttggctgaaatggaagtggtatatcaagccggaagtcacgcaagtagagttggtgctttagtgtgttgtttgctttcgctgttatcttctgtgcttgctcatactatgatttacagtccgtgggttatatacttcagcattattgcaacacaatggttagttcgttttatcaaaatgaagcgaaagagcgatttagtcttgactgttctgttttttgtgctttccattttggcatttgttggatttgttagccatcttttagaggtgagaatatgaaagaacaattacaactgaaaaatcacttaaaggaagttcgcacagaagcaaatctttctcaagctcagcttgcagaaatggtaggggtatcaagaaataccattagttctattgaaacaggacagtttaatccaactgcaaaattggctctaattctttgtattgcattggacaaaaaatttgaggaactattctatttttaggaggtcattatggaaaatattataatgttgattttgggagtgttcatatctgttttgggaattgtaaatatcaaaggcaatatcagcacaattcactcttataacaggcgaaaagtaaaggaagaagatataccaaagtatggaaaaacagtcggcacaggaacgctgattataggaatatctcttgtattaggttttattgtttcgttttggagtgaaataattatagattatatcattcttccagcagttattgtcggattaggctttatattgtatggacagttcaaatacaataaaggaattttttgagaatcagggaggtataaagatggaattgaacacaatatcaggtctggcgatagcgggagttatctgctccgttgtcctctcgatgggggtaccgattgctttgttcattgcaggaagggtgaagcttaaggcaaggatttcctcgttctttatcggagcaggaacctatctgctgtttgccatgctgttggagcagcagctgcatgctcttgtcattcagttctgcggactgaacgcacagagcaggccatggctttactatgtgtacgcggctttggctgcagcggtttttgaagagaccggaagactgattgccatgaagttctggatgaagaaatggctggattttccaaatgcactgatgtatggaatcgggcatggcggtgtggaggccattctgatcggaggactctccggaatcagcaatcttgtgtccatgctgatgatcaacagcggagccatgcagaatacgctggcggcacttcctgctgagtctgcaaaccagaccgtgtcacagctgtcggccttatggacaacaccggcaccactcttttttgtaagcggaatcgaaagaatcagtgccatcattctgcatatcgggttgttagtctcgcacactattttcagatgcccggttagtatgcataaaaacataaatcatgagtgcttacaggtttattataagacaaaaaaatagaattgttaaggtgcattacagaatttaatcccgcatagttacagataatccacagctggaatttagtttttcatttaagtttctatttttcatcatgctgcgtggaaatattcttctataatcaagtcaagtccgcgtacaaaacaccagatcatgttggcagagtcgtcttcatacggttctttccataactgttcaaagataatctcatgggtaatcacctgtctggaggactctgccagcagatacaggaatgccttttctcgctcatttaggattgcaaactcatgctctccccagtaaaccgtatgataacaccagtcaatcagaagttttcccttttgtataatcttctgcttttctcttatcaatactgcgtcatagaccgctatggtatggaatttttcaaatgcatccagattaacggtcgtacattcccactcagtttgtaacccttcacaaagccgactccacttatctacctcatccgcagcaatcaatacttttttcatttgtatcccttttcttatgttacttcattttttaaacagaaaaaattactactttttgcaatattcataaatattaaatggttcttctcttttttcaaataagatatcagcttctttcctttgatgaaaatctgatttctgacactcttagtctcctttttcctgcactaaaaaaacgccacaaattgtgacgttttttagtaccctttatatttcagtgagatttcttgattctaaaactcgctttttccatattttacagttaccactgcaacaactttttcattttcaaacacttcataaatgataatataattttctacaatcaactgcctatatcctttaaaagcataaaatccatattttctttctgcccctcgatatggctgttcttccaaacttaaaattgctttttcaagtttttctgccagtgcaattgcatcatcagcataattactaacaagaagtgcctgcccgtatatcttatcaatatctctatatgcctgtggaaacatttttacgatatatttatcccaaatgtttcctcctgagttctcccaatgcctcacgtgcatctaataattctgcaccttctgcgacttcccgttctgcttcaaaaattgccttatcaatctgatttgtgctgagtaattcttcataagtttccatactcataactactaaatctccataaccattttttgtaataaatactggttgctgttatttgtgacatatttcagatatttcatttgtatttcttaaatctgtaattggttttattattggcattgtaactcctcctttctttgtacattattataacagaatattgatggagtagattactaacttctttcttcattttccaaaaccttctgctggtatctcatgtctgccaccgtgtacactgtgatgaaagccttcggatcaagattattgatataattcatgagtttctgatactcatttttatctacgatcgtaatgatctcgtgtcttttatctaaattgtacgctccgatggcatcataaatggttgctccactatgaagctcatgcaaaataaaattccgaagttcttcttcatactttgtaataatacatactcttcgtttcagattctgcccgaagataaaatggtctaccaccatcccattaaaataagtaccaagaacgcttaaaaccaccgtcttcttatcatatacaagtgctgccgaaagcgccacacacataccggctaaagacatggctttccccaattcgatgtgcagatatttattcatgatcttagccacaatatcaagtccgccggaagaagcattcatattaaagagaatactgagtcctacactgactaccagaacataacagaggacatccagttcctgggtttttgtcagggaaccgatattcggaaaaatccgttcaaaaataccgataaataccggcagtaagatactggtatacacggttttcgtaccaaattcccgtccacatgttatgaatccgatgatcaaaagaacaacattcaggaccatcgtgatcactgaaagcggtaaaggtataaaattcgtaagaataattccaagaccggaaatactgctgaccgatgcatggctcggcaccagaaagaaataaaccgctgcagcgataattgccactgcagcggtaagtgtaaatagttcccatacaacttctttgcaattgatttgttttttcattcccaaacctaccctatcatgacatttttatagaactgctattttacttctctgctcggaaggacttgcagtgctatatatacaagtatagcgtatgcacaaaaaaattgatagtattttttaatttatgtaaattttattgaatcctgttgttactgttcactcccgtgtcaatcactacgctgattggcacggaggatgcacgttttatcttgaacggcatctcgcccatcgccaaaggcgatttaaaatggcgagatgcgttgctggtcacaggtactgtggacagtaacatcctgtcttttgaatcttattcagcaattgcattcccggtgtacaactgataatattttcccttttctgaaatcagttggtcatgggtacctctttcgataatgcgtccctgttccagaaccatgatacagtcggaattccgaaccgtagacagacggtgtgcgatcacaaacgtagtacgtccatgcatcagtctgtccatgctttcctgaataatacgttcagtacgcgtatcaatagagcttgtagcctcatccaggatcagtaccggcggatctgcaactgctgctctggcaattgcaagaagctgtctctgtccctggcttaagtttgctccatccccggtgatgaccgtatcatatccttccggaagtctacggataaatccatctgcatttgccaattctgctgctgcaaaaatttcttcatctgttgcatccagttttccaaaacggatattgtcttttaccgttcctgtgaacagatgtgtatcctgcaatacaattccaagggaacgtcgcagatccgctttccgaatcttgtttatattaattccatcgtaacggatttttccatcctgaatatcataaaaccggttgatcagatttgtaatggttgtttttcctgctcctgtcgaacctacaaaggcaattttctgtcctggctctgcatacaatttcacatcatgaagcacgatcttatcattattgtacccgaaatccacaccatcaaatactacatttcccttaagctcaatataatctaccgaaccatctgcctgatgtgtatgcttccatgcccagcatcgggtatgttccttacattctataagttttccattttcttttttcacattgaccagagtcacatacccgtcatctacttccactttctcatccagaagggtaaagatacgctctgctcctgcaagtgccattacaatggcattcatctgctggctgacctggttgatcggcatactaaagcttttattgaatgtcagaaagcttgccagtgcacccagtgtaaatcctcccacaccattcagtgcaagggcacctccgacaatcgcacagactacataactgatatttccgatctgcgcattcaaaggtccgagatagtttgcataggtattcgcacggtctgcgcttacaaaaagtgcctcattcagctctttaaattctgccttactttcttcctcatggcagaagaccttgacaaccttctgcccattcatcatttcttcaatataaccattgacttttccaagatttttctgctgttccaggaaatatttcccactctgtccggcggctttcttggtaccaaatatcataattgcaaccatgatcatcgtcacaaccgtaagtggaatatttaagatcaacatactgacaaatacactgatgatcgtaaatccgctgttgatgatctgcggaatactctggctgaccatctgccgcagggtatcgatatcgttcgtgtaaattgacatgatatcaccatgtgcatgggtatcaaaatatttgatcggcagcttttccatatgttcaaacagctcattacgcatattcatcatcattccttgtgtcacattgatcatgatacggttatatgcgtaagtcgcaacgattccgattccgtaaaataccgcaaccctttcaattgcatgtgcaagcggtgaaaagttcggtgtaccgtcagacagcaggaacggtgtaatatatttgtcgatcagatctcttgtaaacatcgttccctgcacatttgcgataactcctacaaatataaggataaatactgcaatacaatgaattttataatcacggaaaatgtagtttatcagacgcatcaaaagtttccccggatatttcactttattctgtggtcttcccatcggtcttggcattatgcttcacctccgttttcatcaaaatctcctccgccctgagtctgcgattcgtatacttcgcggtaaatttcatcggtcttcagcaattcttcgtgtgtcccaaatccatgaacctgcccttcatccataacgatgatacggtctgcatcctgcacactggatacacgctgtgcaatgatcagctttgttgtatccgggatttcttcacggaatgcacggcggatcttcgcatctgtagcagtatctaccgcactggtactgtcatccaggatcaggatcttcggtttcttaagcagtgctcttgcaatacacagtctctgcttctgaccaccggatacgttgtttcctccctgctcaatgtgggtattatatttatccgggaaacgctcaatgaattcatccgcacatgcaagccgacatgcttccatacattcttcgtcggtcgcctctttgtttccccagcgcaggttatccagaatacttccggtaaacagtacatttttctgcaatacaacagatacctggtttctcagtacttccagatcataatccttgacattctttccgccaaccaggatttctccgcctgtcacgtcatacagacgactgatcagattcaccagactcgtcttcgcacttccggttcctccaatgatgccaatcgtctcaccggaatggatgtccagattgatattcttcaggactttctctgcactgtcttttttgtaagcaaaatctacattcttaaatgaaatacttccatctgtcacttcataaagcggatgttccggattatggatatcgctggtttcatccagtacttctgctatacgccgcatacttgccatactcatggaaatcatgacaaataccatagacagcatcatcagactcatcagaatgttcatacagtatgcaagaagactcatcaactctcctgttgtcaacgatttcactacgatcatctttgcaccaaaccagctgatcaggatgatgcaggtataaacagtgaacatcatgatcggtgagttccatataacatttttctctgctcttacaaaaatatcgtaaatattcttacttgcatactgaaatttacttgtttcctgttcttctcttacatatgcttttactacacggatcgcagatacattttcctgaacggatgcatttaaagcatcatattttggaaatgcctgctggaaataagccgttgcatgacgaatgataaagaagaggatcactcccagaatcacaactgccacaaggtaaatacttgccagtctggcattgatcataaatgccatcaccattgcacaaatcatacttgccggtgctctcatcatcatacgcagcatcatctggtacgcattctgcacattggtcacatctgttgtcagacgtgtaaccagacctgctgtactgaaatgatcaatatttgcaaacgaataggtctggatctgatcgaacatcttatttctcaaattcttcgcgaacccggtcgaagcctttgctccgtatcgtcctcctgccattccggcaagcaggccacaaaatgcagccacgatcataattccaccaactttgtaaatatggtgaatatctccggtattgacacccttatcgataatagatgccatcagaaatggaatcaatgtctcaaacaatacttccagaatcataaaaaacggtgttgcgatcgatgccgctttatattcttttacttcttttaataaagtccgaatcatgaattctctcctttcattttttccatattgtaataaactttatcgatcacatgcataaatgcatgtaattcttcttctgtaatgccttcttccaactgcgcatccattttctgaaaaatttctcccagtttttcatggttttcccgtcctttttctgtcagcattacttttttcagacgcgcatcatttgcaaccgatgcacggcagatgtacccttttttctccagagtctggataatatttgttaccgctgaacggcagataccaaaatacttttctatatctttctgataaatttccttatcctgatgttcatatagatagcgtaagatccagccatgcatcagggcaatctcatccagtccttcttcttttacacgcatttccagcagttttgaaatcgaacggtctatccggtgcacctgatgtcctacgtggattcgctcttcacatccttcacacaaatgactttcctccttccactttttgcttcttcaaaaaaagaaaactgttcacgaataaattgttcattcgtaaacagtttaattctaaacaagtttatcacagatatttccctgctgtcaacctgctatttactattttccatccaatcaaaaagctcacagttttttgcgatcaaaaccgctgaaaccggcattatcattgtgcaggaaattgctccaaaaatcatggaaatacagttctgaaaaagaattttggagttgagcaacagctcaatggagtaattctgcattctcaaatacgcgaataacaacagcgattctcccagatatgcaaacaataacgtattaaccgttgttccgatcacatcttttccaatcttcattccactttgaaccagtttgttcattttgatatccggcttatgacatttcacttcatatacggaagttgttactgtcagtgccatatcgatcacagctcctaacgtgctgagtacaattacggctgttgcaaccttgggcatactgatatccaggttcatattataatagaaaacatcttctccggctgcctggatctcattcaagcctcccgccccacttttccatacgaccagataaataaatgcaaataacacacacattgtaattgcaaccgcaagaaatgcactccaggttttaatattcgtcccattttgataaaacaaagtgatacaggaaattaaaattcctgcaccggcagtaaccagaaacacgggtgctccgacggcataaagccagattgcaagactcaggcacaaaatatttcccgccagagcaatcagagacatggcgcctctgtcccctccaacaagcactattactatcattagaatcagtcccaatatgatcaacatcttttttccctctttttcacagatagtttcatcataactgctgttatgaaaatagacactgggatcgccagtacaattccgatactttctacaaagaaacggcataattcacatggaatatgcaattttacaatggtaacaaaacgcacctcattgttcatccggatcaaacatgtaggaatcagaccgcagccaaacacaaacaacagcacattgatcattgttcccataatgtcatatccaatctctctgcccgaacggaaaagttccacaaattttacttccggtttctgctcaacaatctcgcttaaagccaccgatatggcaaccgccacatccatgatggcaccgagtcctgacaacaggatctctgcatggaaaatttcatccggattatcaatactgcccagatattccatcgtcgaataatccagttcttccatatgctgcataacaagatcaaatatccccatgatcataagcaggacacatagtgttgtcaatagtgcggcaaaagttttcctgtggattccatttaatccaacaagcgttaccactgcaaaaaaaaggatcagtctgctacatacactcagaatttccgatgtgtcatccgccgtccagaaaccgatcacaaaaatcaggatattcatcattgctgttatgatcgtcaaaccgccctgccgtccggcaatcccaaggagcagaagtgcaaggaagccaagcataacaaccagcatcgtatcccgctttactccaatgatcgatgatcccttataaaacacccggtcacctttatggtatttttggtcatccatttctgttgttgtgtattcattggcaatccggacttcttttcctttgtcttctccgtttatgattttgccataaagactctgcttatatttcgtttcttctgttccacgtgtacttttgcttttcccttctacaattgtcaccacttttgtcactttcacgatcggtgtctgatacagccaggcatcattcatgacaaacaaaattgccagtagatacaacacacctgccacacaataaaatcttcctcttttgtttttcatcaaatatctgctaatctttttcccgtattccttcataatccatcttttctcttcttattcttttatctgcatatccgcatctgtgatcctgcaatacaaagtctcatcatttggttctttatatgtctcgaacgttccctgaacgataatttctgtttcctgttccggataatcttcatccgacaattcttcctcattttttcggacaaattccagtccctgcgcgcagcacgccagcgcatctttgatcacgcaaaaatgataggcattccctgtcgcttcatccttacttatataataaatcccgtcgatccggattgtttttccttcatactgctccggttccaccatcatctggtaaactgtcgcgtagaccatatcactgttcatttctgtaagatcataatctacatcttctgtccccatattttctgaagtgtctgcactttcttttttcttgtccttttcctctgtctgttccttctgttcttccgcttttgtctgtttctctaatacatcattaacggatttcccgttattcactttcttgttgctgcttgcattatctctgcatccggttatcaaaagaattcccacaaacaatatcagccatttctgtaattttttcactttatttccctcccgcgattttttcgatcacgcagcagatcaaaaaggccacaatatcggctgccacgatcgttgaaccaaccggtgttcctgccaggattgacaaaagcatcccactgatcgcacagcacacagataatacaaccgaacataccgttacgctgaaaaatgttttaaagatacgcatcgcggatagtgccggaaagatgaccagtgccgagatcagtaacgagcctaccaggttcattgcaagtacgatgatcagcgctgtgatcacggcgatcagcaaattataacggtctgcccggatgcctgttgcctttgcgaacgtttcatcaaaggtcacgcagaaaattttatgataaaatacgataaataacacaacaaccacaaccgacaataccacacacagccacacctgttcaatcttcaatgtcaaaatagaagtagatccaaataatgtagtacatacatctcctgaaagattaggacctgtcgcaaatacattcataagcagataaccgattgcaagtgctccaactgagatcattgcaatcgccgcatctccttttatttttgtattttgtcctgtccgtaataataaaatcgcacatacgaccgttaccggaaggatgaacagcatattgtttgtaatatttaaaaccgatgccaccgccatcgctccaaatgcaacatgggataagccgtctccgataaacgaaaatcttttcaataccagtgtcactccaagtaaggaggaacaaagtgcaatcagtacgccaacgatcagtgcataccgcacaaaaggatatcccatataaaatatcagtttttctatcatttttcccctcctgtatttttcagagttcttctctttgtacgcgcccgcagataattttctttcgattcgaaaataacttcctgaccaatctgcaggatatgacttgcatattccatggtcccacggatatcatgcgagatcataatgatcgttatcttgtcttcccggttgattttctcaattaaccgatacatttcttctgtcatttgtggatccagcccggaaaccggttcatccagaagcaggattttcctggtcgcacaaagtgctcttgcaagcagaactctctgctgctgccctccggacaattctctgtagcaacgttttgacagatgagtgatctgcagttttttcatcatatcttctgcgtaatttttttcttttgtacggtaaaacggccagaagccaaggtgattctgacatccggagagaacaatttctctcacggatgccggaaaatctttttgcacctctgtctgctgtggcaaatatccgatttcattcttcttcagtccatcatagaattctattttcccgctcaccggtggtaaaagtcccagtaaagtcttcataaaagtagatttcccagccccattttccccgatcacacacagatagtcccctttctttaccgaaaggtttatattctgcacggctgtttttccttcatatccgattgccagatcccgacatataatttgtgccatattccctcctactgcaaagcttcttttaatacttcaagattcttttccatcactgacaggtaagttgtgccattcttcacatcatccgatgttgtagactgcatagaatccagtgtcaggatcttctgatttttctctttggtgttctcaatgatcgtctttgcaattttctgattggaattttcaatcgccatgatatcctttagtcccaactcatctactttattcgccaggaatgaaattgtatcaaagcttgcttcactttctgccgagcatccgacaaatgcagcataatagcttaatccataatcatctaccagataacggaatggaaaacgatcgccaaacagcagtgttttctgtgacgcgccatcaacaacttcctggtacttagcatccaggtctttcagcttttcactgtatgcagatgcattctcctgataaatatccttatgatccggatctgcttttttcagcgcgtctgcaattgccttactcagcacttctgcattttttacagacagccatacatgctcatcatattccggttcttcttcctctccgccttcttcctcttcttcaggctccattccttcgatcacttcttcctctttcgcactgtttccaagtacatcgagcagattgaccacctgcatatctttattcttcgcctgttttaacgcatcatccacccatgcatccgattcgccgccgacatatacgaacagatcacaatccgatactttcatgatgtcctctgcagtcggctgataactgtgcagatccacaccattgtcaagaagcatggtgatatccatctgatccgcttcttctcccgcaatctgacgtacccagtcatattccgggaaaatggttgtcacaactttaatatcagaatctttctgaacttttgtttctttaattggaattttccttccggcaggcagaaatgcccagagtcgccatcgcagcggccagtagaattgctatatactttttcatgaataaaacctccattatctacacttatagccatgagcaaaactccacacattcagtatttatgcgggtttgcgaggcatggcaacctcattaatcacttcaaaccaactcccgtgtccagaaagtaaaataatagaaaatacagcaaatatcacaaagacaatccacactatccaatcagaacctgttgctaaatctactaatttcatttataagcacctccttaaattccgtttttcttaattcgataaactgaaatttatataattatctctctaactttccccattttataggctttcccgcctgtccattagtgaaatgatatgtagtttcccttatttttgcccttatgagataatcacaagggaaataagggaatttttttagtcattgcctaccactttatcaagaagccgaaccgattttcgtttcgcatctcttgtggagtgagcatagacattcatggtggtacttacatctgagtgtcctaataattcctgcacatcttttggagcagctccatttgccaaaaggttgcttgtataggtgtgacgtaactggtggaaatgaaagccttcaaatccctctaatgtttttgctacctttctgcataccgtccccaaagtagtcggaagttccagacaaccatccggtcttaagcagacgaaagaaatttctttataatctgccgggacttcctctgttctgtctaagcaataatattcgtagtacactctgtttttctctttgacctctttgtagtagttcgtgtgataaagttctccgtactgcatccggttttttaactgctctttccgggcattacggaaaatctctaccagcgtatctccaaaatcaacaacccttacttttttccgcttggttggtccgatgatatatttgcgctttgagccatcatatcggatgctgcgtcttatggtaaggcattgttcttccagatttacatcctgccatgccaaaccgcaggcttctccaatacggagtccggcataataagctatctggattggaagtattgcggctgggttctttttttgcagataagcaagtaatctttcataatcttctcgtgaaattggttggatatttccgtccatatcctcatcggaaaacaaatccacttcatccgtctgataccgcagtttaatatactgcatgggattgaacgtaatatactgctttggaaatactgcaaaacggaaagattgctgcatgactgcggaaaaagaatggatataatctttgctgtaaccctttttctcttttccatcgggatgaactcccccaaaggaaagcaaatcaaagaaggattgcaaatgctcagaggttacattttttaatttccgttctgccagcggatgtttcttaatatttcgtattgttccgaggtaattctccaccgtaccattgctgagcgtacttgtttttaattcctcctctgcccacacatctaaaagttgtccgactgtgagattttccgctttggcaacaaatttctttttctcataatcatccattgcctgacggagcagcttttcagtttcacttttgctttctgttccaacgcattctttctgaacaagattgccgcttgcgtcctctacatagaagcggtagtaccatttctttcctttttttcttacagatccttttgccataatcgtatgtctcctttcgatattagacaatcggaactgatgaaatgcttcgtgcgtgtaagtatatcataactccggttgtcttactataccgattcggaatcttcgtataagacttctgataaaagatttgcaagcctttgttctgctgtttttggtttcttggaatagagccttacaacgtctgccatctcattaaaagcattgatggtaggagtgatttcccttaagaacataatctcattatattcatcattcgattcaaaccctattgttttggcaatatccgtctgaccatcattccccttgaagtttttgcaggcgaactgaaaggaatccaaaaacagaccatattgttttaacatcagcagtaataaatcttttgaaaaagcatcttcttctttggtaagggcaagcggtaactgttccagaatatctcccatcgcatcacgaatctgtaactctctcttatccgtaatgtcggtttcatattcatctgtttcccctttgagccattccacagatacatgaagtgcttccgaaagaccttccagcaccatttttttcgtattgtcaatcgaaccattctcataacgcaggattgtagaagcggtaacccccatcttttctgcgacataaggctgtgtcagattcaattccagacggcgctgttttactctgctgcctatcagcttgcgtagttctttatctttcatgctgactgcctcctttttcggtatgtatgaattatagcattgcttttccaaaattgcaatatgcaatataaaaattgtttttaatatttcgtaacgcttgacaaaaagatttggaagggatatacttacatcacaagaattgcataatgcaatttacagggaggtgattatatgacgcaaagaaaaattgcattatccatcgaagaagctgccgactatacgggaatcggcagaaacaccttaagacagcttgtagaatggaagaaacttccggtattaaaggttggtcgtaaagtcctgattaaaaccgatattctggaaatgtttatggaagcgaatgaaggtcgtgatttgagggatagaggaaatgtaaaagccgtaacaagaactgcggcaaattaaaaaggcggcttccaaagaaaccgccaaaggttctatcagaccgaagccatgatatacctacacgcaagaagattataccatgtgcttcttctgatacgcaaccgagaacttatgtttgcaaaagaaaggggaatgtaataatggcaaaatcaacaaaaagttatgaagaacgaatgcttgaaatggaaaagaaggaacaggaaagccttgaaaaagcaaaacgatatgcagcacagaagaaagaacttctaaaacgaaagaaagccgaagaaagtaaaaaacgaacccataggctctgtcaggttggcggtgcggtggaatccgttcttggtgcgcctattgaggaggaagacatcccaaagctgattggttttctgaaaaagcaggaagccaatgggaaatttttctcaaaggcaatgcagaaagaaacaaatactgatatggaggaagtgtaatgacggaggggatgagtttttcattcccttcattgctttttcatgaagggcgcacttatggacaaccagaggtcgtcccaataagtttgccacaagtggcaaccggtctgcgctcacgcttgccgggctcgttccgtcggcggggctttcagccagacctgctcatgccgcaggaggcactcttcgccagagaggcgcattccatgcaggctgctatgcgcagggcactcttacgcagagggcgttccggcaatgctgctttttctaaaactgaaagcaatgttgccggaaatctatgccggatacgtcagaaaggaggaatccagacatggcgatttttcattacacaatcaaaatagtcggacgaagtaaagggaaatctgttatctccgcttccgcatatctcaatggggatgtgatgaaaaacgaggaaaccgggagaatcagttattacacttctaaaaaagaagtggtctacaccagtcttatgatgtgtgaaaacgtacctcctgaatggcagatagtactagaagaaaatataaaacgctttcaaaaatctgtccgatacaaaagatcagaagataaagaagctactttagaaaaatttaaaatcacatttcagaaacaaaggttatggaatgaggtattgaagattgaaaaaaatgcagatgcccaacttggcaggtcatttgaatttgcccttcccaaagaatggaacagacaggaacaaattcaatatacaactgactatattcaaaaaacttttgtagatagaggaatgtgtgctgattggagtatccacgataaaggggatggcaacccccatgttcatcttcttctgactatgcgtccttttaacccggatcattcttggggaaagaaagaagtcaaggattgggattttgtcagagataaaaacggaaatatcgtgattgatgaatcccatccgaactggtggcaggataagaaaaaccctgaccgtcatggaatccgtatccctgtattagacgaaaacggaattcagaagattggtgcaagaaaccgcctgcaatggaaacgggtgctgaccgatgctaccggatggaacaatccaaaaaattgtgaactgtggcggagtgaatgggcaaaggtgtgtaatgaacatcttcctttgcataatcaggtcgatcaccgttcttatgaaaaacagggaaaactccagattcctaccatccatgaaggcgctgacgcaagaaagattgaacaaaagtttcttgccgggcaggaaataaaaggttcgtggaaagtagcggaaaatcaaatcataaaacaacaaaacacgttattgcaaaagatactggacacctttggaaaagtatcgggtgcattatcattatggaaggagcgattaaatgacattagaagaaagccgggaaattatacccttaatggaatccatgattgggcaaatcgaagaacagcagaccttaatggcagaaatgattctggaaatgcagaatcgggacacccaactctctcttatgcaggaacagaatcagaaattgcaaaaattaaacagcgagttatccgagctgctcaacattttgccaaataccgaggaactgctttccaagatggaagaacagaaaacgaagatagaacttttggaaaacgaaaatcagcaatggcagaaattggtacagaagctgaacagcgaaaacagtttattactgaaacagaacaccgaattgctgaactggaacagcagatagagaaaggacgtgatatagatgaacgaatccagagaatcaaagaacgccgaacagttggaagaacttctcctcttgaccgaggagatacaagaagaactggaacagaaagaccagcttatcgtggaactaaagacgcagctcaacgaatctctgaccttgaacgagaaattaaacaaagagaacagagccgggaatattcaagcattaaagaacgacttgaagctagcagacagagcattgcggaacgagaaagagaagctgcgaagcgcaaacgtcacgataggggaatgtcaagataaaatacgatgcttaacacaacaacgggattatgcccggacacatcagaaaatcgtagagataccggtagaaaagccggtaccctatgaaaaatgtgaagcctgtgaccggacagcctatcagaatgaaaaagcgaaatacgaaacacaaaaagagcgacttgcaggacagtataaagcaaaaacggtaatgttccaaacaaccttgttccttcttgcatggtattcgctgacaaccactctttttcaggcagtacagtcagatgtgtttctttccgattgcaaatcattcttccatgatgcagcgtcattcatacaaacttttatcggttggacgattgaggtcgggcaatctgtggcacagattagcacaaaaattccaaatccttttatagccggaatggtatattggatattgctaatattgattgtaggaatatgtgtggcaggaacagggatactggcgatactgatagaaataaaggttatagaattatatagggaaaagtgttgggatgtcattactctactgatgatactgacaagtgctgctgtcatcatttattttggagaagcaatcaaaaaagcactgtcagtaaatcttctattgctttttgtacttttgcagggcgcatatgttggacttaggtgttatttagaatcgtaccttgagaaaagaaactattaagcattttttacaaagctatgtacaaaatcattctaaaattcccattcaataatacgattgagaaaacctctctgatacagtataataaagtgttagggaggtatctctatgaaggaaaaaatactaatcattgaagatgattttacgatacaaacacagcttaaaactcttttgtatgggaatggatatgaagtatttgcagttacggatttttcccaaacaatagagcagttaaaagaagctgcaccacatctggttattctggatataaaacttccggggaataacggttttgaaatatgttctcaaattcgcactttttcagatattccgattgtatttgtaacaagcagcaatacagatatggacgaactaaacagcattatgctgggtggagatgcgtttatcacaaagccttataatcctgctattcttcttgctaaaattgctgcattgttaaagaaagcctaccgttcctctcaaacagaaatttatatgtggaaagaagctaccctgcatttggagagtagcatgatagagtacaaaggacagaaagcagaattgacaaagaatgaattgaaaatcctctactacctttttaagaacgctggaaaaatctgttccagaaatgatattgtggattttctttgggataatcagctttatgttgatgataatgccctaagtgtcaatattacccgtattcgtgacaaactggcaacaatcggacttgtagatttcattaaaacaaaacacaggcaaggatatacattatgaatggaaaacaatatttgaaaaatcaactccccgttattttaatcaatctgctgggtatgcttgcctttgccttgttcctgattgcaagcgataatcctatccaaacagtcctgtttattcttgcggtctggtcgattgtccttgttttatctttgctgactttttatttctcacgaaaaaagtatctgaataaattgctcaatatgacggagcaattagaagaacgatatttattgccggaaatcatgcaagtgccggaaagggctgatgaacaggttttttaccagattatgaaaatggctgaaaaatccatgttggaacggattggcgaagtacagagggaacgcagggaatataaagaatacattgaacaatggatacacgaagtaaaaacaccaattacagctatgaagctgctgtgtgagaataaccgttctcccttttccagagaggtattggcagagttagagaatatcaatcaatatacagaacaggcactttactatgccagaagtgaacacgctgaaaaagactattctgtccgtgaagtcaatttatgcgatgttgtgaatagtgcaatcgcagataataagtatcttttgcgtcaaagtaatatgtcaattcagatagacgatatagaaacaatggtttacactgatgaaaaatgggtgcggttcatcttaaatcagattatcggtaatgcaatcaaataccatgcagagcagcctattttgcactttggggcaacaaaaacgaatgacaagattgtgctatctatcagcgataatgggataggtattcctaaaagtgatttaccccgtatttttgaaaaaggatttacaggtcagaatgggcgaaccgggaaaaattctactggaattggcttatatctttgcaagcgtctatgtgataaactgggaataggacttactgcttattccgaaaacagaggaacaacgatttcacttatctttcaaatgaatgattttattatcggagtgcagggctgacaggttctgcacttcttacatttttgtaagaactgtgtaagaaaacttgatacaaaaaatgagatactccatttacaatatgggtatggaacagttaaggaggtttatccgatgaatacaattttgaagctggagcatatccagaaatattatggcaatgaggggaatattaccaaagccattaaagatattagtttttctgtggaagccggagaatttctcggaattatgggtgcgtccggttctggaaagacaacgctgctaaactgtatttctacgattgataccgtaagtgcagggcatatttttttagagggaacagatataacggaaatcaaaccaaaattccttgcccgctttcgcagagagaatttaggttttgtatttcaagacttcaatttgctggatacattgacaatttcagaaaacattgcactggcattagcaatcaataaagtccctgcagggattgtagaaccccgcattttggatatagccggaaagctgaatatcagcgatattctaaacaaatatccttatcaggtatcgggcggtcaaaaacagcgttgtgcctgtgcaagagcaattatcaacaatccgaaactcttattggcagatgaaccgacaggagcattagacagccattcctcacaaatgctgctgtctaccattcaaagtatcaatgaacagcttagggcgacaattcttatggtaactcatgacgcttttaccgccagctatgccaaccgtattctttttttgaaagacggagaaatctttatggaactgcgcaagggcaacgacagcagaagtgctttttttgataaaattctgaatgtccttaccatgattggagggggacagagccatgtatgctaaacttgttttcagaaatgcaaaacggtctgtaaaagactatctggtctacattgtcacaattacaatctgtgttaccttgttttatgcgttcttgtctatttccagtagttattatagcccggatataggcagcgagtatgattttactctgttaagtgacggaatgaaaattgcaatctgcatgataacattgctgttgttatttttgatacggttcgtcaatcattatatgctaagacggaagcaaaaagagtttgctgtccagtccattatgggaatggaacaaaaaactattggcaggattttctttgcagaaacactgattatgggtatgttttccattttgattggtattttttgcggtgtattttgttctcaattcattaccgcaatgctccttactgcttatggaaagccttatgaaatctcatggacattattcccggataccgttttgttgacagtggtattttttgtggcaagtttttttgtggtaggaattttcaatacccgtaccattcagaaaacaaaaattattgatatgctttccgcagagaaagagaacgaaccagagctaaaaaagagccgcttcatttctgttgtagtagtcctctttgaagtatttaccgtatggggattgattgcaggaatacaaaaggtctggttttattatgacacccgctttgcgtttccggtgcagcttatgttttggggaaatattctttttccgctgcttactttgctgtggtcgatattttgcataatcagaaagaaaaaaagagaatgtttcattgctggtttgctgatatgttctgtattgaatgcttttacagcagccagcgttgcagcattaacaaataaatattatctgcctttaggtggtggaacgctcaatcaatatctgctttttgttgtgattgacttacttttcttcatttgtgccttcatttatcttaccagtggtttgattgtagcatggaaagaaaaatcgccagaacaccgataccatgaggaagcacttttctttttcggacagattacctcaaagctgaatacgaccagcaagactatggcagtcatttgtatcactttggtattagcaattttcatgttcgttgcagcccctattttgacgggctggtcgtctggttatttggatatacgctctatgtatgatgtgcaggtatattcgagatacaatgatgtttatgaagaagaaaatctgccacaggacagttatgaaatcattactgattttctggcagaacataaaatagatacagactatgattgcactttcaatctatatctgccagagaaagacgattttcacaacagacagaaatatgattttccgattgtggcaatttctttaagtgattataacaccataaggaaaatgttgggttatgaacagatttctctgggggaagatgaatttacgacacaatgggcggcaatcgccaccgaggaagaacgggatagctttttgaaagagcataccagtattttgacagacgcaggagaattgactctttccgagcagtcctattatgaggaagcaatcggagaaacagcgtacaattcctatacagatatactctatgtacttccagacagtatttgtgaaaagctgttgccggtaataaaaaaccgctatatcacaacagaagaaaacatctcctatgaaaatgcaagggaactggaaaaattttttacagaggaatacccagagcaagcagaaagcggtgttatgtatggaatacggttcagtacattacagaggaacagtacaatagcaaataattttgttttacaggctgcaatgctttatggtgctgttgtattgatgattatatgtcttaccgtactttccttgcaacaactcttagacgcaggacaatataaatatcgcttctctgtactccgaaaattgggggtggaagaaaagcatatcggaaaacttatcttgcaacaattaagtgtttggtttgggcttccaattatcacagcaatcattgtagctgctgttgtaatagcttactttatccaaaccatatcagcagaaatttcagcctatatcgggtttggtgcattgatgttacaaataggggcaacaatgggcattttggcaattttattgatttgttatttcataagtacatggattatttttaggcattctgttaatccatagaaaatatgtaattattgcatttcgcacattctttaaagagggatagcactcttaatgaacactatccctctttcacttaataaaattctaatgaatcttctgcatccacccacatctgtaaattgccctcaagatataatcttgcatattccaaaggctcatccacagctaatgaagtaagtgcacattctgatccatatgtggtttttaaatctttttcagcttcccagcagtcaatgcgaagcatatatccagcacttgtgtaaacatcaatactatcgtgatttatgttgtattctgcataaattgttctcatcgtatcttatctccattttcttttgataatcagtaatagagttaaatatcgaaaacatttcaatcagttcaccatgtcgttattgttatatgttatactgtgttatgaaattttctttcccttaatttttcccatattaaggttcatgaaagctaatgggagaatgtaacacaagggaaagagtaagggaaagtacacttgctacaaacttagtattttcaagggtttgcgaagaatttgataatcaaatataacagttattaaatttcctaaaatatgtgaaatatcaactggaatttataacagtccttctgcttttacccgaattgcataaaactcttggaatgtatctgattcgtccattattgtttctttcataatttttaatctccgtttaccaactcgtctatccaatacagcaaatatttttacgattaaattttcacttttaaggcttgtttcaatatcttgattatcaaactctgcaaatgcattataaaaacagcgttggtcaaaaattcccaattttatagctacatcgtccatatacgcattttctacttttatgcgtttctcatatttttcgtcttggggaaacatgcctgctttcgaccaattgttccaatagcatcctttgatgatttcttttccatcatatcttattgccgcccgtccctcatagtcgggactcttactatatgatgttacataatactgaatatgaccttgcagactttgagccagatattccgtttccaacttttttcttataccactccatgttgccattcattattctccccaaataccgatttgtctgtttcatgttatacacagtataattccattttataaaatattcaattaaaaaggtatgcgatcccggaacaggcttctaccatttccagatgtggcgtaccatccagcatcatgttattcagttttgttacaatatttatcatcaaattttcctccttaaatttccatatcccgtccgtgcttgcggacatgagctgtgtgttcacgagtttcttttccccttgcgaggatggcagaaagaaaagtcctgacccgttctgctgcgatttccaacgcatccagatagggctgggctttttctttcagttcattatatttttcgttcagttcgtcatgccgctgtttccagatggaagcggattttacagcggaatccagtttttctttcaggcgactattctcagcattaaagataatcccgttgacagcgtagcgtttcagggtatcgcactggtctgctgtgagggtgacatttccggtaaaggaatttttcttacccattgcttcaatatcctgcacggttattgccactgtctttgctgtcttggtttccttttgcagagctttcagcttcttttcctgcttttctacggcggattgggtgtcagccaaggtctgttccgattgttccacctgtgcggtcacagcttccagacgctgggtttcggcttgcaccttaaactgtgttaccgtcagatgttcctcagtgctgccacgctctccacgctccacatcggtatacccggcggcttgcatgaaattgaaaaagtcatcctgcaatacactgtaggatgacttcaaaatctttttgccttttgtattcagcatgggattgccgttcccgtcaagaacaggtttggattcccatttcttactgcggctgacctgcatgatggtttccttgactgtcccccggagggcttcgtccttgcaccgcttcgaccagagaatctgtttttcaaccaccgggatatagaccacatggaggtggtagtggtacacatcctcgccaagagcttccgacatagcccggttgcgctcatcggcgtgcatgacagcagagagaatatactgttcaccgcccaccacctccacggcggctttataggcatcggcataaaactgtttggcaaattcatagccgccgtgattgtagaagtaagcggagttcacatcgaataccagctcaccgtatttcacggcatccgctttcagccctctggtggagatcaccttgtcctgttccatctgggtaaacatttcttcgtaaccggctgtcggctctttgaaatgaatgttcagagaagaacgatccggcacgatgtcctgattgctgtaactgtctttttcccgttcgttgtgttcctgcacctttgccagatcatcggcggtttctatatcctggttacgggcaacggtgcggtcaattccatcatttcttgccatggggcatgctcctttccgagaagatttgtgagggatgaggggcttgcgagaggcactttttcaaagtgtaataacccactattacactttcatccatactggctgcaaagtgccgtgggctctccgagggctcctccggagggggagtgcggtcactgcggtgacctctgctgtccagctcgaaaaatgccctttgcctttttctcttgtccagcctgtctgccagcagaattgttccacaatcccttgtagacagcggcagcgaacaaacagcagcattgccgattgtattcactgccagtccataggaagcactgcggcacttcctatggggacgggagctgcgaggggataagatatgccgcatcatcgctccccccgtttctgccacacgatgtcatagcccagcacatcggcaagctcgatgacctctttgtagcggatgctctctctttggagctttgcagaaaggttagatacgctgtccgaccagccataatcctccgccagcttgtccaccacatcctgcatggtaaatccggcacggacgatctgtgccttgatttcgtttcgtacattgctcatattgaaaaacctccataatttgttgtaaaaaaagcgaagctggtgcgcccattggcgtgtccgcttcgctgttccgtgtaatatttgactttcataaaatgcgatagaaatatcgcctgtgatgtcctgcccgcaagtgaccctatcccagtttactgctttttgtgctttggcctgaaacagcgaaaaccgccattatttcgtaaagactgttcactgtccagagaagcactgtttcgcaaaatgatttcgccctacggttaaaaacttcgccgtttccattaccattgattttccagccctcaaaaagaggggtgcggatgtttctaaggcggaaaaacgatagtaagcgaaaagtacgtgtaccaagtgcacgcttgacaatcggctccatccggtacggatggtacacgtacttctgagttactaccgctttcatagaaacggtctttgcagaagttcgatgcccacaaaccctctggcaaatcgtccgccgccaatgttgaccttgttggtgtattcaaggttgtatcggctttcattctgctttagaaacgagcagaagctcttttgggaaaggctgttcaaggcgttatcatcacaccactgcttgtaaacagcgtacagatttttggagcttgcttcataatctgcacggaagcggatatagccctcagaagccagaaaatcaatgatgttgtttccgtctgaaacggcatcgttcagattgtccaaagccgactggctcagggtaaatcggaaattatttgcaattagacggtgcagcccctccaatgcccagaggaagataccctccgcttcggcagccattttttccgcaatatagggatcgtcttttctgttcgggtctttttccttggtggtcaaaatgatctgtctgcggaagaagcccacactccggtcatggagagcttgcaggacaccgttcccaagcccgatgaaccgcacatataaatctccctgatagctttgctgtctctttctctccaaatccataggtagctctgcggtgataattgctttgatattgttggtctggggcagtgcttccagcttcatatcatcgtccagcatcaaaagctcatgttccagatcggcacgggcaaagttgcttgtctccacctttgccacacttccggttttcatgttgacacccagcagcgcacgaagaacaacaccgatccggctctttccttcgccgccctttccggtgagcatgagcatcttctgacccttggttgagggaatgaagcaatagccaataaattcctgcaaggtcaaaatgtcctctggctccaaaagctgggacaaaaaatgcagccatgtcacaggctgcggagcatctggttgataggaaacgggcaagcgattgcggcagtaatctttttccgcactgaatgtgccatccaaatgataggtgccgtttgccacatgaatacggtcttggtacaggagaagatcatcggcacagcactccattcgcattacatccagcagatttgtgaccctctttgcaatgttgctggtcacatagggcttgatacggtcatagatttcttttttcagcctgttttcatcgttcacaatgccattgacagtgaagaaagttccatttaccgtaatcatgggatagtccctgagaaattcttcacagaaaatgacttcgttgattgctttgccgtcaaaccaaatcggcatattcgtatcaggcaatttcctgttctctgacatggcagcgcacctccttttcctgcttgtccagtcgttcttgcatttttgcaatcgttccatctgtcaaaagttccttgaccgtatcagtcctttcttcgtagtcgctcataatgagcaaatcggtcagatactccacatagcccagctcgtgacaggcttccacgaacctctcatcaagttcgtcttccggtgcttcgggagcataccgctctttccagtcctccaaaagatgaagatacccggacagcacattcaggcagaaaagctcgtcctgcttcaactggtttacacggggacggggctttctgacctgtgctaccacggacggcggcctgtccagcccgaagtccacagcaagtctctgcgctgcttcataagcggacatgtcaaacagccttgctgtgaagtccaccacatccccggcagtaccgcaaccgaagcaatagaagtaatcctcgttcagcttcaagctggggtgtctgtcatcgtggaaagggcagcaaatcatcccggagcgattgattttcagcccgtagtgttcggcggcttgcctaaccgtgaccgccgccttgactgtttcaaaaatgttcatttgcataacctccttgatttttctcgatgattttttcatctgcctgaatatacgcagaaaaacgctttcaaccgaaaaatcaggcacatccgcaagcaaagcaaaaagccgccccgaaaacttgcatttttgcaagttttgggacggcagtgttcacacaatattggttgatattgttccgtaaatagaatataattaaagttactatgaaccaggagggacgatgcagatatgaaatacctgtctacatttgaagttgccgaaaaatggggcatttctccccggagagttggtattctctgcaacaatgaccgaataccgggcgcacagcgggcaggaagccgctggatcatcccggaggacgctgaaaagccgacagatgcccgcatcaaaagcggaaaatatatcaaactgaaagctgacagagaggaggaagcataatggcagatacttatttacccgccgatgtccgaaaaagaatcgttgatgtgatgagagaacgcaagatgacccagcgagagctggcacttcggattgatgtaaatgaaagcacaatcagtcgcttcctcagcggaaagacagagaagttgagcgaagaaagcgttatccgcatcgccagagtgttcaatgtgtccacggattttatcttgggtactaccgtaatcccggacaaaaagaactacgatatttcagagcttgggttatctgttgaagctgcaaagaatctttataccggaaaggtcaacaatgatgtagtcaaccgtctgcttgaaaatccccgctttgccacggttacttatatgattgcacagtatatggatgatacccttgcaggaggatatgccgcacaaaatcagatgtatgctaccctcagttccatgctgctggggataaacaaaaccagtgccgcagtacaggcagcaagaaccgccaatgctatgaaagttcccgcttatcaggctgaccagactacgatccagaacacctttatgacggtggttaaggaaatcaagaaagaagcaggcagcgatttggccgcagccaaggcaatcagcaaggaaaccactgagaggatgtttaccgagctgaccaagggacaggatacgcccgttccgaccattacgccggaagctgttgcagatgccgtcacgggcagtgtttccggtatggattatgtcaatcaggaagcattgctgaacttcaaccagtcattggttgaccttttgaaaacgactctgcaacagccggaatcacagggacaaagcgatgacaccacagaataacgaagaactctgtattgcggcgcagggcggcgacaaatgggcggaaaatgcccttgtagagaacaatctgcgattcatccgaaagacggcatatgaaatatggagcgcacagcgggagctgaacgctgccctcggcattgaactgaacgatttggtgcaggagggttccttggggcttctgggctgcataagcagctttcaacccgactacgggaacaagtttctgacctatgctgccccggctattcataacgccatgctggactacatccgcaggcagaatcccacctttgaagccaaaaatctggactgtattatccgtctggatgaggtcaaaaagggcgaaaacaagggacggcatgaatttatagccgattccagaatacagaacccggaacagattttcatcgccaaggaaactcacgaagaaatccatacagctctgcaaatgattgaggaacgagataaagcttacctttggtatcgttttggctttgaggacgatgtactccatcccttgaacgaaacagcgaagcacttccacctgtcagagagcagggcaaagtccacggaaaagctggctctggataacttctggttggaattgccttggtggtattgagcgaaaaatagtatagattggagaattaaatggaacaaattttaatcatagaagatgatacaggcttaaatcaaggattatgccgtgctttgaagtctgaaaaccgccaagtcgtttcctgcctgaatttgaagaccgcacgggaacagttagcttgcggcagcgtatcactggtgcttctggacatcaatctgccggacggcagtgggctggattttttgcaagagctgaaagccgccgccccggtgcgcccggtgattttgctgactgccaatgataccgatatggatattgtagttgggctggaacagggtgcagatgattacatcacgaagcccttttctctgtcggttttgcgggcgagggtcaatacgcagctacgaaaaaatgcggtttctgtccctgcaaagacttttcaaattgaccgttttgtatttgactttgaccagatgcagttttccgcagacggtgccaacgtagaactcagcaaaacagaacaaaagctccttcgtctgctggtggaaaatcagggcaacgctatgagccgtggcgatctgatcgaccgcatctggacggatggagcggagtatgtagatgaaaatgccctgtctgtgactgtcaaacggcttcgggataagctgggagcgcagaactatatccagacggtctacggcatcggctatatgtggggaaagaagcatggataattggattgtaatactggaattttcctgcgttctggctgcggcacttgcaatttatgcaaactaccgccgaaccaaaaagacgatggacacaatcgatcagatgctggatgctgccgtcgagggtacttactccgaaacaaattttgatgaaagccgcttatcggctctggaaaccaaatttgcccactatctatcctcctccgctatttccgcccggaatgtgaccatcgagaaagataaaatcaaaacgctgattgccgatatttcccaccagaccaagacgcccattgccaatcttctgctttacagcgaattgattgcagaggaagaattgcccggggatatgcactccaatgtggaagccatccatcagcagacagagaaactgcgtttcttaattgattctctggtgaagttgtcccggctggaaaatgggattttgaccctatcacccaggcaggagtctgttcaaccgatgctggacggtattgcggctcagtatggttccaagacaaaacaaaagggattggtactgcaaatctctgaaacaacttcttctgcctgctgcgaccccaaatggacaacagaagccttgggcaatttggtggacaacgctatcaaatacacgccctccggcagcgtgacgatttccgcagcagaatatgaactctttacccgtattgatgtgacggacacgggcatcggtattgaagaatctgaacagccgaagatcttctcccgcttctatcgttcggaagccgtccgggaaaatgagggcgtgggcatcggcctgtatctggcacgggagattatttccggggagggtgggtacatcaaactgacctcggaaccgggaaaaggctccactttttctgtatttcttccgagacaagctgaaatcttacaaaactgttagaattgaactccgtcttgaaagattgtggaaagaattgtgtgatatgatctgtatgtaggaacataaaaccctgcatacagattttttaatggaggtacgagtttatgaatattttacaggcaaatgacctgacgaagatttacggctccggtgaaaacgcagttcatgcattggatggagttgatttaagtgtaaagaagggcgaatttgttgcaattgtcggcacatccggctccggcaaatccacgctgctgcacatgctgggcgggctggatcgccctacaagcggcacggtcatggtggacggacaggatattttctccctgaaggaggaagcgctgaccatcttccgccgcaggaaaatcggctttgtatttcagagctacaatcttgttccggtgctgaatgtatatgaaaatatcattctacccactgaactggatggcggaaaggtaaacaaggcttttgtgcagcagattgtacagacgcttggactgagcgaccgtctggatgcgctgcccaatcagctctcaggcggtcaacagcagagagtagccattgcccgtgcgctggcggcagcacccgctatcattctggcagatgaacccaccggcaatctggattccaaaaccagccaggatgtattgagccttttgaaagtcaccagtcaaaagttcgcccagacaatcgtaatgatcactcacaacgaagaaattgcgcagatggcagaccgcattatccgtatcgaagatggtcggatcgtctcccagaactaacgggaggtggctacgatgaatgtcaaaaacagaaaatgtattcgaaagctcagcttaaaatctctttatgcgaaccgtcgccgcaatctgatcgccatttttgccattgcgctgacaacgctgctatttacgtccatgttcaccattgtcttgtcgttgaacgccagctatgaaacctaccagtttcggcaggtaggcggctatgcacacggcacctttaaggatgtttcccccgagcaggcggaacgtatcgccgcccacccgaaggtaaagtctgcgggggcacggaaggtgatcggcatcactgcggatggtgtcttttccaaaacgccggcagagatcagctacatggatgccaactgcaccaaatggagctatgccacccctactaccggacggatgcccgaaagcggcaaagaggtgaccatggatacggcagcgttgcagctgcttggcgtgacgccggaactgggcgcagaggtcacggtttcctattccatcacggacaaggatcaaaccgcctttactgtaacagatacctttacgctggtgggctattgggactatgatgaactaatgcctgttcattacatcaacatcagccgtgattacgcagatgatatcgaagcgcaggcagtgaaaacaggtttacagcccttccgcactgacctgaatgtcatgatggcttccagtacaaacattcaagggcagatggagcaggtggataccgatctcggctacacatgggacagctataccgatcccaacagcgtccggatcggcgtcaactggggatatacctcatcccagctggagtcgcatctcgatccggaacttgtgatcgccatagcagcttttttgctgctggtgattttcaccgggtatcttatcatctataacattttccagatctctgttgcgggggatatccggttttacgggcttctgaaaaccattggcacaacgccccggcagctcaaacgcatcattcgccagcaggcacttctgctttgtctgatcggcattccggcggggctgctgttgggctatggcattggcgctgttctggtgcctgttgtcttgcgctccacccagttggatgcgggcatcaccaccatcagcacttcgcctgtgatctttgttggctccgtgctgtttgccctgctgacggtgcttttgtcctgctccaagcccgggaaaatggcagccagggtttctccggtggaggctaccaaatatacagatgcgatgcagaccaagaaaaaacagcgcagcacccggggagcgaagctccatcagatggcctttgccaatctgggacgaaacaaaaaaaagacggtgctggtggtggtgtctctggcactgtcggtgacgctgttcaatgcactgtgtgcctttgtgggcggcttcagcatggagaagtatgtatccttcatgacctgcgccgattttatcgtcagcacgcccgactatttccgttacaacccggcagatgaattcatcacgccggaacagatcgaagagatcgcagcaaatacaaagtccagtctttccggcacgggatatgctgtgcgaaaacccgtatatctttggatgacggaggatgctctgcggcaggactatgcaaggtacgaaagtgctgagcagttggacagccatatgagccgcatggagcaccggggcgatatggtgatgggagataccagaatcgaggctctggataacagcctgtttgacaagctgcaagtgttcgacggagatatttctcctatgctggagccaaacaataacgctattgccattgcggtttccttagatgactacggtaatctgcccaatcctgaatactaccccaaggtgggagacacgatcaccgtcacctatgcggacgatgtgaaatatatcgacagccgcaccggggaactccgcaccgaagatacaccggaggagtactttcaggaaaaactgtatggagccagagatgtagagtacacggtctgcgccttggtagagcttccgtattccatgagttatcgttatggtggtattggatatgagacagttttgtctgtggataccgcacagagggacagcggcggtgcggccattccgatgctctacctgttcgacacagcagacgacgcagacgaggccgaagcagagcaatatctatcgaagctcactgccggtgagttttcacccttgatgtatgaaagcaaggccacggctcgctctgagtttgctcagttccggcagatattccttctggtaggtggtatcctctgtgctatcatcgggctggtgggactcttaaatttcttcaacgccatgatgaccagtattctttcccgccgccgtgaatttgctgtgcttcaggctgtaggaatgacgaaccggcagctcaaaaccatgctgatctacgagggattgttttacgcaatgtcctccgtatcggcggcctttattctgtcgctggcggtgggacctcttgcaggaaaaatgctgggcagtatgttctggttctttgagtatcgattcaccattctgcctgtcctgctgacaattccggtatttcttctgctggggtggctgattccttgcatgatgtatgacaatgcagcgaaatgcagtgttgtagagcaattaagggatgctcaataactgttaagcaaaaaacggccctctgccaaggaaaaggcagagggctgagttttaatctaagggtttacattcagttacagtttttagataaatttcgggatcaccgttcaatatcaagtctgcatatccaatcggatcattgtagatcagatagtccaattctgaccgctgatacatattatcggcaacctcattctccacggcggtacagtctattgaaatcatgctgccatcagcgaagcaaagctccacgcaggcggtgtcgatgttaaattcacaagaaatcatatttttcatggtattaacctccgatatacatattttgaaaagaaaaactcccgcccaattcctgttaggaatcagacgggagttctgtatgcacccgaaatccgtcagctaacagttgataagtgaattagttccttatcactgttaagccaaagccatccgggagttacccggtttttgtagccgtcagacggcacaagcaggtaggaatggtaaagcccattgatctgcacataatgggagtgcttgaaatccacactttccggtgcgagaaactcgttgatccggatgtgatccagttcctccatgcgattttcctttgtataggcggacagtacagtgctgatccggttcgaaagcggaacctccgtacaaagggtacggtttaaaagggtgtagagaacatccgtagtaaattcatcctcattgtcatgggagaccacttcattcccgcactggtatagaaaggttttggcggtctgggaggctgtctcaagagcagcaaggatttcccgttcctcttcctttcggtttgcgttgaatggttcatattcaaagatcagaaagaaccgtctggatactgcttctctggaacttaagttctggacaaactggatgtagtcacgctgcagttcctgacagtggggatcggtttcccgctccagctccagctgggactgctccagatgcttattgatgtctgcttttttggagatcatcttgatctggagtttgacagggctgatctttaagtaactgataaagctgtagataatgccctgctgttccctggcacttcgaagcagaaagttgattggttcaatctccaggatcttcacgtaccgtccgtctgtggtatagacgattccgtttgcgattttttccaccggaagataatcctccaaggtctggtctttctttcgctttttccgggaaacgggttttgacgtggcagatgaggtgtcctccttggaaaccaccttttttttctgctctttttttgcagcccgcttttcggaaactgcccgtttttcttcctcctttcgtctccgggcttccgtttttttctgtatttttatctgtttcgccgcctcttttttctgtcggctggcttctttctgctcccacttcagataacggatatcttcctttgcctgttttttgatgccccgcttggtggaggtatcaaactgccggtgttctttttttttactttttggcggagctggtgcgtccggttcagactgtgggggagccgatgccattactttggaaggctctgccattttttctgctttccggtgtttctttgtctttggctctttgaaacgtggtttcctgcgtggctttccttccggaagactgtcggacctccagattaccctgcggttcactacaaaacgcagggcattcatcaaaaaggcagtgatgctctccccgccgattccaatcagggctaccattgccgctggaagtgcggtcatgcagagaatgatgatgcgggcagtcagggacagcggcaggtggaaaacagggataccgattgccagggaaagaacaatgctttctatggcattgcggatgtcaaaagttccgtttaggatcttgcctttctcaatgaagttggaagggataaaggaaaccggtgtttcttctggctgtgtcatggctgcacctcctttttcgtatctttcgcatcttcggaaggcacagaggcactgccggattctgtgtccggagcttccgggctgtcagaagtatccggatacccgccttcctgcaggtgttcaatgtcctgcgaagtcagggacggcagggaatcatcggtttgcttttcgtaaacagtcgtatctgcagagacctgtaccccgtcttctccaaataaaaacacacccgtcggggtgtgataggtaaccggaagcgtatcctgatcggaaagtgaaaacatcaggcagacggttgtttcggtagggtagctggttttttccggcaggaaggtgatgcttgtctgttcttttttgacatactcttttaggtagacaggaaactgccctttgagagaagcaatctggctgtcggagaaaaatgcttttaaagcatcaaaatccagatattccggcatgggggtatcagaatttgtttctgttgtttcctttgccggttccctgcctttgtttccggaagcttcttttttctggcttttccagaaactggggagaaccagtccggcaagcagcagaaacagcatcagaaaaatggaaagaatcacttttgttctgttcataatggctcctttattttttgtcgaagatccagtaggcatttgccgtagcatggatttccgacatcatatcaaattcacggttaatatagttctttgcgtcactgtcattgggatcattgaccagtaccttgccgtttgccgtaacacctcggagtacgatgaagtgtccgccgctggtgaaaagtcctgcccgctgagaggagatgaccggacagccttcggagagtgcctgaagtaccgtattggcattgctggtctgtgtgacgctgccacagccgaaatgactggctgcagcctgaaagtagctccagtaggttccaactcccggcttgtaataggaattcccgcaccatgccaccgcatccggaggggtaatggtattcccggtcaggtagctggcgatcatggcaaagctggtaggcccgcagccggaagatgcgatggagccgccgccataaggaatgttcccgtaatcggtctggagatagtgcggaatctgcattccgtttgccggatagcttccgccggtattggtaatctgataataccggagaacatgctccacatattccttgtccccataccggtcataatgccagttcggacgggcacacatcatatccgaataagcaatggcgttttctttggtataaccgccgtcacgttccattgcccagtcgatatagccggagccgtaattgtaaccctgaagcgccagcttgatgcggtccaggtcggtaggtccggtacatcctgctttatccagtgcatactttaattcctgaatcccacattcgatggaataagcaggatcggtgatgccgttggggacatgggggtatttcttattaaagccgccttctgccgcctgcatgggatcgcttccacgcccgccgctttcctgcatcatgactgccatgaggagttccacataagcttccatgccgtatttctgtgcgacctgctggatggtagcccggtaagccagcacctcatcgctgacacctaccgccatggcaagaccggaagcggagccgccaaagaacatggtcaggttttccacataactgtctgccgtttttttctgcttatcggtcagatgaaagacgtgatctgcaaagtaggcatctccggcatagctgaccgtgtaggtatggcgggtaaaagtaacctttctgggtggtgcattttcctcttccgccggaacttccaccgtggccgtttctgaagtaacgtcataagaaaaaagcccgtcctcgttttcccggatcaggcttttgagtttgctgatatttatatttttatagtcatcctggctggcacaaaactgtgcgatgagctggttcgcatttacgatgatactggaagcgtaaggatcgctgatagaggcagtatctccttccgggagtctggcaatttccgcattgatcttagcaagcagtgcatcatggctttcctgaagcacctccacgattgcctgattggaagcccggatattttcactgattaccgtgttgctggtcagtgctccggtattttcagagaggtctccgaagacgagtcccggaagcatgacaaggaacagaatgggaagcatcagtacaccgccgacggctgctccagttttcgcaagggtgcgcctgtgccggaatactgtaccgatgacagcaagaggactgcccatcaaggctgtttttggcatgttacatacgctcctttcgctgtggggctggcggcagtttctggacaatggattcattgtaggctactttgccgctgccggaagtatatggtgttttttcgaccgtatcctgtgcatactgcttgtaccaggtggaaccatccacggactgtaccgtagagtaggagccctgagtaggagctgcatactggtcggcatggtacagggcaaaatcccggtttccggagcttccggtttcggtaccggtgatccttccgccaccgatttctacattatcataggaagaaccgccgcccggattgatgcccatataggaagtaaaggctttctgtgcgtctgctcccttgatggaacctacctgaccgtaatttccctgtgcaatgttgctgatgacctgattggcaaagtctccgcctttgttcagggatgactggtagagcatgtttccgatactgctgtgttcggtataaccggttgcggaattgaccgcttctctttgtacctgtcttcccactgccccggcaagcccgccggataggaagcttcctgcgacagccgcacttccgggagaagaggctttgtggtagccgccaccaccatgggaacgcatggaaccggtcaggctccgtcctgcaatcagaagttcagccatcatgtttcctccggtattgccgacattgatgccaagcgatgccagaaaagaatcaattttctgggatacctttaaaaaggcaatggcacacaggaaccagacgaagacatttccggttaccgcttcctttccctgactggcaactgccgcttccacgtctgcttccgtaagctccgctgcaaagaccggcatggagcaaaacagtaccagacaggcagttagtaccaggaatggtatgagtttctttctaagtttcattttggtcctcctttcttatagggataacggattggcaaggaaggtgccgaccatagaagtaaacagccgcaggcaccacgcattcatcagaagcaaaaagaactggccgccaagcatccggcaccagcttttgaagatatttccggttgactggctggcacccatggaaaaagctgccggggctgtgtagaccagtacccccagaagaatatagcgttctgccgcttcaaagagcagtttgatgtagttccacgccagaatcagtaccagaatcagtgcaatgatggctaccgccccatttgcacagactcccaggatgactgtgactacggagttaaaatccgcaaattttaaaggcggcaggtcttccgtcagaatccagttgtacggtgttcctgaaatcttcaggagcagatccacaatatctttcgcatagaaggtgagaaagataaagaggaaggaacggatggacagcttaatgggatcttccgcttcgataccggctcccataaagtaatttttaaagagctgccatacccagtttaagaggatcagcccgatgcccagtgccagaaagacctgatacatggtctcggcagcaggaaagtagcgaagaaacgtatccatggaacagcccagagcaccgaggactgaagtggtgatcagatccagaatgttcatgacctgttcggcaatccattccacgattccgtcaagtattcccatagtggcatctcctttcgtctatccgttccattttccgcctgcaaagaacggggtgatgtaagccatgataaagccaagcccgtttaagatcgcccaggtaatgacgatacgcttgagccatgcacgtgattcgtccacggtttttccgcttttggaaaaattcatcatcagaagggcaaccgatgccgttacgactgcagcaatggtggaaatgaggataatctggttatagacatccttcatgatctcattggctttggtccagatggtagcggcaaaaaccggctgtgtgtatccgcagaggactgtgacagccagaaatgcagcatacaggcatctgccataattgacatgccgttttgtgtccggcggagcgtttttcagtttgtgtttcacgtaaaagtacctcctttttataagagcggcaggagaattacctcccctgcctttgcttatggttttcctgcctcaagaaaggacgcagcccggtcaatgcaggctgcgtcctaaatcaaagtatgaaattgtaaagatcctcctatcttacagaaaaaacgcagcttatttgccacaggagaggcttcccatacggcagtgctgcgtttcgttctgcatataattttgacaatatcaattttaacatgggtaaattaccgctacaatcgcaggactgtgccagttacagacgatggagtgccaaaaatgtgaccaacgctaaaagcgttataaatgcaatccttatggatactgtaagcgtgatttgcaaccaattatactggatttacatgactaatgctttaagcgttagtgaatactggaaggaggaggtgtgcgtgtgaaaggaatgggaaaggcaatccgcaggtacagggaagaggcaggaattacgcaggagagactggctgaactggtggatatcagtaccaaccatctgggtgcgattgagcgggaagtgaaaacacctacgatggaaacatttgtaaagctgttgaatgtattaggtgcggaaccgaatgaagtgctgaaggaagtgattcctcttaccagaatggaacatacttctgtagtggaaggaaagctggaaaggctcacaccgaagaagcaggaaagcgtgcttcggatgctggatgtgataattgaagagatgatgaaatagaagctgtctgcgaaattgccgcaggcagtttttttgaaagctgtatatgcaataaaacacataaaaatatgcgatttatgatgaaagtgattgcaagatttgatatagtaatcctaaaagcattataaaactaattcttaaaggatgactataatatgaaaaagggatatgtgggattattggcatgtgcgtcaggaattctgatcggactgggaatcagccggctggatctgacaggttatcttgaaaaaacacaggagcaggaatatcacccggtagaaagaaaggtgcctgaatcagtagaaagcaagctgaaagatccaaaacagtgctggctgtgtggaagcgatgaacggagtatgatggattatttccggaagtttgacgatctgggagtgatctgtaccaatcactggtatgtgatggatatgcatatccggaatcatgatgaggacgggaatcttaccggcccgcagggaaacgggcatatgggttataccgggacaggagaaggcggctgctttttccatacggagcagatgtcggattacgggatttccgaagtatcggtggattacggggaagatagtatcttcgatgtgaaaaaagtacagaaccatctgtgtcaggaatgcctggataagctggtggaaagcatggaggtattctgtgaggaaacgcaaaaacccaagccccgtgatctggtactggtggattttcagacattggagctgtacgccattcaggagcataatgcgggatactttatccgggattattatgtggaaattgagtcggaggaagatggggtggaagtaaaggcattttactgcccgaagcttaataacgggaaaaaggatggagaataaattgaggtttgcattggtgaggagtataatgtaagtacgtgttatgtattggaaaaacttgaatttagcagaaagaaggattgttatgaaatttatcaatactagaaaattcacatggataatttgtataataggatttttgcttgctcttgtaagtatatttttcttaccgagtattattccagtacattttgcaaatgggattgcggatgattatggaagaaaaatacaaatatttttatttcctatattacaagtgcttatcacttttttgactggacgagaaaaagtaaaatattgcctgacacattcaaaaactttcttaacggacattcagtttaattggatgatagatggtgtacttttattggtaatgtttgcagaaatatgggttatctatgcttcatttgcatagaaatacttgcataacaatttacatttgattgagcagataaaaatgatttgaggtggtagcaatgaaaaagcgattgggaatcatagccggaattttaggaattgtattggcagtcattggcattgtactgaagcagaaagaaaacacagccgtttctgttattggtggtgcggatggcccgacttctattttcatagcagggaagttaaatggtgataattttatttttatgattgtagttggaattattttattgattttggcaggagttattttttacaaacgtaagcattaagttacagttttttagactgtgtatggcggaagaaccgggaaagtgtagatatatcatggggattttggaaaaaaataaaaaaagtaagggtacagcgtttgtctatgatgagaataatgattactataagatggaaataaacgggattgaatttgtctgtgacagtatacattccgattatgagaagcatgcagttgaactggcacaggcgtatgagaaaaggctgccggatatcgtggattatcttatgccggatataaaggagatgtttggaattacaaatccagatgtaatagcaaactcactaggaaagccgagtatagatttggatagaggaacactgacttatctggagcacacaatggacagcctacatattattgaaatggaatttgacggtatcttcacggcattctataactcctgtattgatggataggactttagtaacatagagctgcagttgtctacagcttttatccagacttcggatgttacagagaagcaatcagaaatggattgatcgatttctgaagcagtatccggtgaaatccttgaacatatgaaggaaaagtatgtatgttaattttatttttattgtagacaaaagataggactgatatgataaaagaacaggttattacaaatagaggtggagtatttgatgcagaaaatattattactggaggatgacttgaatctaaatcggggaattgccctgttactttcacgggaagggtatgaggttcgtcaggtttatacaataaaggaagcaaaagaagcatttcaaaaaggagattatgctcttgttatcagcgatattacattgccggatggtacaggactggattttggaaggatggtacgtgcaggtggagatacatatcttatctatcttacggctttggatcaggaaatagatattgtaaatggttatgatacaggggcagatgattatattaccaaaccattttcactgatggctttggtgtcgaaggtgaacgcattgatgagacggctttctaaggtacaggcacagattatgtcttccggagagattacggtgcatatgaaaacgatgcaggtgtataaaggggatgaaccagttactttaagtaagaaagaattctctctgttgctgtatctctgggagaatgcaggacagattgtttcaaaagaaagtatcctggagcatgtatgggatatagacggtcaatttgtcgatgataatacggttactgtcaatataagcagactgaagaataaacttggaacagaagagatagcgaatgtgagaggactgggatatatatggaccggaaaggtaaacaaaaattaaaacggtattttatcgtatatgtaatctttgcagtattttttacagtaggaatgtatctgataacaaagtatgaggaaaatgcgaaagcaacgcagatagcactgctccttgcagaacatcctgaactggaaggggaaatagttgcaatctgggaaaagtcaggaacagtagattttataagagaccgggacgatcagaagatagaaagagtcgtacagatgctggaagaaacttatggttatcactcagggagtggatcttcagatgtggttataaggattatctggggaattggattactagtgggagtcatagtatgtagcctgttcttgtacctggaccgaagaaaaaactggagcagatacggtgatgaggaacaattacagcaattatatgaatgtctgcaggaattcagaaaaggaaaattccaaacatatcctgaagaaacatcagaatcggaacaatggttaaaggtgtgggaatctgtaaaggagctggggcaatatttcgaagatttgaaggaacgtctggagcaggaagaaaatggtacgaagagtctgattacagatatttcccatcagttgaagactccgcttgcatcactccggatgagccatgagctggtggcagaaaatcgggttacaggagaagaacagagggagtttctggagcaggaatcacaggaacttaccaaactggaacagctcttgaatgaactggtaaatctttcaaggctggaaacacatatgatccagatacattcgcttcatgaaagcctgaagaaaacgctaacagaggctgtcagtcagatttatatgaaggcaagaggaaaagatatttccattcaggtggagatggatgatgatatagttgtgaaccatgattcaaaatggacggtagaagcattaacgaatatccttgagaatgcagtcaaatattcaccggaacatacaacgattacagtgaggacgcaggagctagcaagcaatgtgcttattgaagtagaagatgaaggaatgggcattcctgcggaggaactgcataagatctatcagagattttaccggggaaggaaagcaaaggaacaggtaaaagacggagcgggtgtcggtctgtatcttgccagaaagatcatagaagaacagggggggacaatagcagccaaaagaaaggctgagaaaggtatgatatttaaagtgacactgccgctcataataggagaatagtcggaacccttacaaaactgttatggttgttgtaagggttttgtaatgcaggaatgttatagtaggggtatgaaatggaaaggggacttgaagatatgagtagtattttaaaagtagaagatctagtaaagtattatggagaaggcgagaatcaggtgagagccgtggatcatacaagtttacagatagagagaggcaagtttacagctatcgtaggacgttccggctccggaaaatctacacttctgcatctgattggagggcttgacagaccggattccggcaaagtatggattgatggaaccgatatctattctcgaaaagatgataaactggcacagtttcgaagaaagaagataggatttatctttcaggattttaatctgattccatcgctgaatgtgtgggagaatatcgttcttccgctgggacttgataatcgcattttgtcttcatgagatatatacaaaaatatatgctttttgtgttatttatctcttgacatcacaccgctggactgtattctgataattggtggaataattcccagaatgtcctgttgattttccataggtgttcgtgtcaattgttgccttgccaagaagttcgctgacatatttatgtgttccctgctcattgccgcctaaatataaaaattcatcacaatttcccataatgctttcccactgcttctcaaacaatgcttttaactgcgccaaattctgcaaaataatactgactgacacttctctggaacgcatcacagacagaatcttatcgaagtcatcaggcagtgaaacatttgcaaattcgtccatgaggaaatgcacatgaaccggaagtctccctccatatttatgatctgccagatagaacaactgctgaaataactgggtatacaaaattgacactagaaagttgtaactggtgtcgttgtccggaattaacgcaaataaagccacttttcgctctcccagtgatggcaggtctaaatcgtccgttgcggtcagtgctgccagactggataagttaaatttctcaagtcttgctgcaagtgtaatctgaatggactttaatgtttttgcactgccggaatgataatctttgtaatacttcactgcgatgtgttccgggttcttcatttccaaccgctcaaataattcatcaagtggtgactggtactggtcatcgtcctctctgacttctccggcacgaagcatttccattaccatcggaaaattctgttcttcttccggtgcttcatatctcagataaaaaatcaatgccagcaacaacatagacgctgccgtatcccagaacggatcgttagactgactgccttttggtgtagtcgctttgaacaggttcgttaccaatctctgcacatcgttatcgtccttcagatatacaaacgggttatagcaatggctcttttccatatttatcaggtcaagcactcttacttcataaccgttttcttccagaagatacccggtatctctcagattttccccttttggatcaagcaccacaaaagaggtattcgcctgcatcagattcggctttgcaaaaaatctggtctttcctgaaccggaaccaccaatcacaaccgtcaatacatttcgcaaatgtttccgcatattgtagctgattcgtacatgcatggtcagcaacttattttttgtaaaccgcttctccctgtatcttcgattgattttcttcacattcccccattttgcagaaccatgttcttcacctcgtcggtaatgtttcctagtagaaagataaatcccgattcccatgccgtaagacataaaaaaaataaggacagtttttacactgtccccacataactgaatcgaaaacggatgattcattgcttccgggaccccttccagaatccccataagaccagacgaaagataaggtgcgacaagtaacgcaaaccagataaccgggataattccaagcaacgccagtatcagaccactctgctcatcatcgttcttcatggcttctgcgtcctctctttcctttatccggcggtacttcgattttctcaatgactttcatcagaacatcatcgacaagctccgtatcctttccctctttcagcatctgattccgcttgtctttcagggaatggaacactacaccgctctcatatttatccagttctaacgtaatcgtatcactgctcattttgcattctcctttccctgatttttctagcgtgcttctttcctatgctgtcctctggatttcggttcctttttttctggctctggattttctttcttggctttctcattttcaggactgtcttgttctggtctttcagtctctgactgtcggtaagttgcatttcgattctgatccagtacctttgccattcttgcggaaattgcattcgctgcatctctggctctggaaagttccgcccgcacttcctgagtctccattttttcaaagaactctggtgcatgtgaaaaatcatatcgactggtatctattccatattttttacacaacatataagacgcacacgatacatgaaatgcatcttcatttttatcatagtgcggattcccatccgcatatccggcaaataccaattccggcacaagattctgaaagatttcctgtgcactcatcccttttcttacataaatacaaccttcttccggtttaaaaaatgctcctttttcatccggcatctgttctggttctgctgcaacaatatttaccggaggggtactgactaacgcccggattaaatcatgttcttcatattctgacttttgaattgttgtatcggacattgtagtctgagaaatatcatatagctttttcgcattataataatttccaactgtaccatcttcacgcttatatgtttttcctggctctaaaatcagaactggattctgtcgttccatacgttttaaataaaatccatgatctctccagtatccatagtcacctaatttctgtgcatctggtctttgtgccagaatcagaagtgcattattggtagtatatcgatcaaaggtactctgtacatccagatacttctgcagcattttcccatccgttgccacttgtgcggttacctgctctgacaactcatagcagcgattcctgttatttttgctttccgcaataaatgcctgtaccttttcatcctgtggtacagccgatgcatttaataaagaatcaaaactattatccataaaatttacctctctttccctttccttggttttcgtttctgttgtggctgctggtggcgaatctgattccggtctttatttccctgatttctcaccggatcatttctattctcacgccgctccgcttctttcttccttgcattctgtatttcccgaagttcctttctgaccgatggtttctctggtttttccgagataaatagcttagaagtaccctctgcggttttctcttgcctctttgaggtaggctcggacagacgggatttggtcgtctttgccaaagaggggttttgctccttcccctctttctttaccggctctccaaaaagctcatccataagctgatcctccttggatttctgcggataatctttctccggttctgcctgtccctgtttttcctgctgaacctgtactttttccggcttcttttcctgcttctctgattttccggcttttgctttttctgcacgtgtccgctcaatttccgtcttaatcttcgctgcttctgttacagatgcaaactggaatctatctacgatacggttgattcttggtgcatcttcttcctttacaatcacatctaccagtccgtcactgctttctttgggatttcggactgcacaatataacacgccatatcgctttgcttcctgcacgaattgtttcagatcactttctttcaccgaaaataccgtcagtggtctacctgatttaaccaatgtttcaagtcttactctgccttttgtctttttcttctcttttaagactgtatacagcatcactgccagatgcttcgcacctgtaccactgatcttcaatgctgcttcaccgacttccaacgacattcgtaccacctgatcagcggcttcgcctgatgtgttcatggctttgttcctccttcttctctttttcttcccgcaccgtcttaaatttttcttcgattaccttggaacgtgcggcgattccatcacaaagtgctgtcttctttctgagcattccgattttctctgtcagaacttttatctgctctttcatttcctctatttcttcttccggtctgtctgcccgaatcttataacgcaagtgcttccgttcctccgcacactgctccattttcttctgcaaactttctttcaacaaaaaaagctgctccgcagtatcaatgtgataatggcagagcagcttcgtctcttttgaaatggtattcagttttaacaaatcctcccggaacaatacatgcacctgtttggcagatattgacaggcggttcttcggcaggattcctaaaagataacagtagtgcagatacaatccccgaagccctctgatttttcttgtctgcttaaagttgccggatacctgaatccggtaatacttcccaactgaaattttcttctcggcaggtaattcattttcttccagaatccgaacccggattgcttccagcgaataattctctccaaagttccgctttagcttcagacctcgctctcgcccttccggacgaatagtgatgtctttcccgaacttaaaagaatatcctttttcccgcaaataaaaaaagaactgtttttcagtcctcgcttttcggattgcttcatcaacatctgcttttaccatgctgtgataactcggctttccttcctgttctgcctgccactcggcataatgttttcctttcccctgttccggctgcccgacaaccgataactgatattctttacataaccggtccgacatcattcgcatatcccgataatcctgatttgtcctgtggtatcttttcccgtcaaggaatgaaactgagttcaccacaaaatgattgtgcagatgattcgccttatccaaatgggttgcgatcaatacctgataccgactgccccacaattcttctgccagcttctttccaatctcatgtgccattgcaggtgtacactctcccggtgcaaaagactggtatccatggaacgctacaatcccgccttcctttccaaaacgctttttgactgcaatcatttcttctctggcggttgtcggtgcacaattaagtcccgatacatactgttccatcagttcttccgattctccgacaacttccatttccattgatttagattgtctcagtctggtcttttctgcattcaccgcataggtaatcacatcattaagtccttgtaattgcccggtttcactttctgaaatcagttcttggctcgtctgttctttggtcttatctggattttccgcataattgattacttttccaatccaacctttgatgctccagattgatgtcactgccatgattcgtttttctccggaagtattactgcttctgtaatcttacggaccgcttcattgaacttccacacttcctgatcgtaacgctgcacatctatcacatttaacacatgtgctttctgtgcaatctgatttaagttatttccaatcttatgaagttcccgcatcatggaataataatctggtggcggtgcgtctcttggaacaacaccggaaatcaactgtctcaggtacgcttctcggttcagtccgcttttctttactttcttatccaatgcctcggcttcctttttgttcaaccgaaaaagaattgctacattacgttttctcaacgctccatctcctttgctttctgtatagaatctggttcctggcgaatctggtgtttttctttatcgtagctgtaaactctgtctgaaaggacttcctgccgttccacttcatttttatttacttcccgtaccatttcaccaagcattttcggttccatctctccattatccggaacgatcagaacttcatgcacagatgacggtaacacataaaatccttctggaaaaagctgttccaatttatttaaaacttctggctgcgtgatcatagatgccccatattgcttttctacattcgtaagtgcatacaacatatcatgtgaacgaaatccaaaatcaacattttcatctaataaatttgttgcatgtccttcttcattaaaaatactcaacaacatttcgtccattgactgaagaatcggtgtatttacaggctgggtatttgctctggcctgatggaacatttcttttgcatccacattccacatcttaagatgttcatttttcaccttcatagtcgcttttccatcgttagactctaccggaaaatccacataacagatagccgacagatcttcaatattttcatgaggcatttcctgtaacattcgtttgtttgcctgggtgtttacaagcatcactgccagatgttccttcactgaatcataatccattgggttgataccgttgtgcacaaacggagcattgcctgcttcttccatgcattttgcaatttcattcatcactttctcaacaggttcacccaaacgtatttcattaaagaacgaccctacataaacaactgggcacacattttcttcctgtagtcttacctgtactcctatcatctggactccattatttttattcatctgcattacctgaaattctgcattctcatatttttctgggagaaaattcctgatgtcctttgctacactttccgcaaacactttttctgctatcatttctcttgcaatcatttcttctgttctcccttcttcttgttcattttctttaaatattcctgatatcgtctttctgctttctttttgtctttcattgatacttcaacctgcatcttgtatctcctttctttttgtctactgaatcttgttaatctgcaacaggcacatcaacactactcctataatgccacctactaatactccacaaataaacttcaacattgttactttctcctttttcattttctgagggtttcagggattctccctgacaagctgccgcagactgccagacaggaaacctgggtggcaatccaaaggcgttgcttgctggtattgtgtattcttctatacccgtctcactgttccgggtatcagaagatttacttgccgaaaagcaaatgttttttattctttcagttcacaaatcccgcaagtttcacacaagtattcacactctgtgcatcgtacattttcatcagttgccatgcattcttcacttgccggacaatacttttgacaactttcacactgctccgtacagccttcttctgacactttttcagcaataattccaagcaattcattctgttctttttcttctttcaactgtgtttccagaaaaatcttcaacagttcttcgctgtctacatcgtcttccatcgtcaaaatcagttctttcttatacacaaccttcaactcatatcttgcaattttcatatcttttttcaccttctatctctcatatttttcatgaccagacatactctttttcatgtttttttctcgctttgtaattgccagatttaacttgatgcagagcagatcgttgtaatcttttccttgttttggtggtacatcttttacctgatattgcttcggaattactgtagaaattgcttttgtggcaagtcttccaatacggtcattatccaaatgaaatacgattgtcttcacctctggatgcatttttagtgctcttgccaacgctgcagggactttacttttttcaatttcttttgctggctgatagacacctgccagtgacaataaatgttctcttctccactccttcccttccaatttcaacaatgtcgcataagataacagatcaatggctgactcaaacagatgcaccatatcacatgatttctctgtgaaaatagaaaaagaataattcttatcgcttccatttgcttctccgataaaactggttccgattcccctaatagctgcatatttcggatttcctttctcatccatccctacaaacaccgtattatgatgaaattcactttcataaactcttccagactctaagcaaaactgaatgatttcattatcaatcccacgttcagaaagatacgcaatcactttctgattatcttgatttttccttggcaacagtaactgtttctccatcggaacattctcatatacagaaagaggcggctgaatatttgcccgttctgcaagcaattcaaccgcctctaaaaaactgtatcctcttactttgatcaaataatccagtgctgatctgccaccggttctctgactccaccacatccatttcccatttgatattttcaaactatcgtgtgttctggtagtgtaggtgttgccagaaaagtgaaccaattcgtatggttcataatttttcaagtacgtgagcaaatccatccgcttgacctcccgcacgaccgatggtggtatatatggcataattttcatctcctttcttgccttagattgatattattggggataatatccgggcatgaaaatagccaggtgattccttgagttggaaccatctggctatgtaaatttacttttacttttttactatctcctcaatcaaaacatctattctatgccttgacatattatcgcagtcttcttttaattcttcacaatactgtaagaatttttcagcatctaaatgatacaaaacatacattatattataacacgtatgatatctatcttcatctacatcgtctaccggaaaagaaattctattatacaaatcatctccatttgtcatgataacgtcatgataataactgctatctaatttatttctaagtttatatgaatactcataagcctttttcccacgagttgtgtttttcaaatatcttacatatgtctctatcgaaaatttcatcatttctttattttcttcttgatatattctttttatcttttccgatgatatatgaaataaatcatacgaataagttagaatttcttcttttccggataagacaatttctttcaacattttatttaaaattttcctatattctgataaaacactttcattattttcctctaaaatatcactccaaacaacatatgagtctgcaaattgatttaattctgccagattctttgcttcaatcatttcttcccttaaagtgggcaatactctctttatctcctcatctgacttataataattagacttacctcccgaattaagaaatagcttgtattcagcatccaattggtctacatttagtaccccttcttcataatattccaatagcatttctactaaatttccactgcattttattccataaagatatcttccaattctatgctgtagtgtatttccaatagtacttaccattttttctacagaatcggtattattggaattagcttctttataatacaagttatctatactctcaacaacaatagcaaaacatatcaaccttaattcttctaaaaattgctcactcatatcacttttacaaaacaattctacatcttcaaaaaaacgttgcgccttttcgagcgtccgtaaatttttgactttatggatttccaagaatttttcaacaaagtctgcatggatattcattttactccatgtcactttctctgcacgttctgtaatatgatatattctttcaatgaccttttcattatacttttcaaatacaacttttttgtccgattgtatttcatctgtattcgcaatcacaataacttttacataattacattgcttgagttcttctataattccaaatatatcttccaaatttatgtcatcactcattctttccaagtcatctattacaataatatgaacagaagtaaactcttttgacaataataaaaacaattctctttcattggcaatgctttgtactacttcctttgcctgaccaactttatcccaaattttcgatagaccatctaaaacattattagcaatttcacctattttcccaccaatattattctttaaagccaattgaaataacgcttcatgatatatttgttttgggtcttttaaaccaaacattgatattttacaaacattgggatttgcttctaatgcctcatttaccgcataagattttccaattccccatgttccatcaaataaaattgctctatacggtagatgatctatgtcactgattatattttttatattatctgctttcatactgtatctttccatccctatttttcatctaacaacttattttccatcatcattccgaatctcatcaataatccgaccaatattacatgtaatctgtcccttacactgatgaatatcctcattgattttcttttcctgctcaatagcaatctctatattcttcgccagttctccaatcgcagcatttttcttcggattgattcctgttctagcaagtaacaacttatagataaatgtctgatgtccatctttttcattcttgataatctgttcagcatttggctcaatatcatcttcgtatgaatttttataatgcaacaacaggaacagttcaaatgccggattgctgaccgctaatatattattcttttcaccttctgctaccaattcgtcataatcaagtactttctcttcaaaaatatctccatcaaatacaacaatcatcttatcccgttctttatcaaatgctatttctgaattttctttctgattttctgcaaattcaatcaaacgtcttggaaatgaaatgtccctgtctccctctgttttttcaagtaaccggatatcgatcaatggatgaatatttaactcttttcggatatcaattaactttttgaaataccatgtttcagtatttgcaccctcacatatgaaaaagtacttacgataaggctcaatctgttcttcttcatctgtagttctgctattccaattcgtataacttcttactggagccaaggctactcctcctctctaaagtcgaatgttgaaaataccggtatcgcaccatatcttccttccagatatgccttgctcaacactttatcatacctctccttgaaacgatctaaggaataaatagagcttgcattttctgcgttacgttctacaaaccagatttcatcccttctaaaaatagcctgatccataatggatgattcatgtgtagtgaacaatagctgcatacgctgctcatcatgtagctgcataaacaattgcaaaaatcgttctgtcaatttcggatgtaagcttctctccaattcatccacaacataaagaacatcttctcgtttattcaacagcatatccatcaaatcgaataatcttcttgttccatcagactcttcatcaaaaccgaactcataaaatgacttattatgatgcaatcggattgttgtgaccttcggttcagaatgtccttcaacttcgatattaaagaaagtttccttcgacctcatcgtcattctgaatgatggttcttcctgctcttccattctattttttacatgttgcatcatcttatcaaatactgatttcggcaatgcatttgataactcatccaatgacaacacgaattgctgatggcaggttaaaatggggaaaacctcattttaacttgtactaaatcttgacataggaccaattgctgttagatagtaaagaacgctcttcaaacttaattatggcatcattatacaatattccgttactctattttttgagtatagtgtttatagcattgttcattggaagtgattttagtggaagaactttaaatacttatattactgccggacataaaagaagttctatatttagagtaaagttaattgtatctcaaataggttgtattatcattctggtatttccattatttgtacatggaattattagtcaattttatattggagaaaaacttttttggaatgatagcacatatactatggttttactaactctgtttgccatgataacactgtgtgcattaccgatattttttgcttttatttttcgtgatatggggaaaacactgacagtttcaatggttttattttttgttatgatttttttgctgaacagtgaatctgcacaaataatcagcagaataataccaatgggacaacttaggttaatttcattgcaaaaggtctattcgacaaacttttgcttgcttgtagattttttatggaattttattttatatttcattgcaggtagtgtttttttacatacagacttgaaataaccggaggtgttttttatggataaattattaaaactggaaaaatatcagttgttacataattctatttactggtgtggtatgattggaatatttattttaggattttttacagcagatacttatgttacagaggtcatgggatcgacagaagaaattgcttcttctcttgctgatatttttaatggaatggtgtatgattctacgtttcttcttatcatcatgtcggctatacttgcattgattttaggacaggaattttctaagagaacaataaacttagaggtcagtgctggacattccagaaaacaaatttttacaagtaaaataatatcgtatttaattgcttttaatcttatggctcttgtctatccagtttcagggtgcataagggaatttggacgctttggtgttgcagacgtgggaatgtttttttacaatattataaaagcaatcatttattcttgtctgcttaatagtgcgatatttctaattgcaatacttatttgttgctatttacaggatgctgtaaaagcaacttcggttacagtaattattatttttggtcttagcttatatcttggctatggaatgatgttgagattaccagtcggttttttacctacttatcaaatcagaatcgttgtcagcatgaaaaccttttttcaaccgatagctattttagtaggatgtatatggtctggtatattggtattgctttcgtggataaaattttgtaaatgtgattttaaataggtggagaaaatgtctaacatagaatggattttaattatcataacaatatttttagtaatactgctatttcgatatattcaattaaaaaaacaaatccgtaatcttgcggatcaagttaatgaattgaattctggaaattcacagcagatgttagacatttcgttgattgataaagatttagaaagactggctggtatattgaatcaatataatatcagacaacgacaggctgttgcaggcgtattacgcaatgaagagtatttaaaagaatctgttgctaatatatcacatgatttgcgtacacctcttacagtcattcttggtcatttacaattattgcaaaaagaaaatttggaatccagtcaagcacagcgtgtaaaagtgatttttagcaaagctgaaaaaatgaaagaattggtagaaacattctatgacctttctattttggaggaacagcagacagttccagaaaaagaaaagtttaatatatctaatatgttaataaatttaattacggaaaatgccgttgcattagaaaaggagaatattttacccgaaataaatctcccagattattcaatatacgtatattctgataaaaatatggtagaacggattttacaaaatctgttgacaaatgcaattaagtattctgttggaacgataaaaataacacttatggagaaagaaaataataatattatatttaccattgaaaatccaatgagtgacagttcagaaattgattgcaatcgactttttgaccgtttttatacaggcgataaatcaagacataatggaagtacaggattgggacttgcggtagtaaaaacacttgttgccattcttggcggaaatattgttgcaaaagtacatgccaatagccttattattactcttgaattataaagtattgaagatatattcgtatgataattcattgaagagtggacatcaaaatgtaaagtcaatagtttgtaaagtccagttacaaactattggcttttttcattactgtgtaacaagtaaatttacgataaagaaataaggatagtcggctcttatttgttgcctgcggagcagatcaacaaataaatgttgaagaatctgtataggaaaacagagaaaacaagaagcaaatcacttcttattctctctgatgttcaagataccgtcaatcgtaccttgaatgatttttaattcattatcactcaataaatcaagtgacgaatctatctgacggcgggctgtgtttttctcaacattcttcgctggatagaaatactcgtcaacagatatattgaacattgtaactaaatcatggaataactgaaagctagggtgttttccgatattttcaatatctgcgatatgacgttctccgtaaaagactttatcgcctaaatcatttctggaaagccctgctttctctctggcttctctgattgccagtcctaaaggacgaaaatcaaagctgtgtgtatctttcttttttctcatttttaatcacctagcatgagtttatacttcatgttgtgcgattagaatgtattaaaaactcatattatatgcactataaattcaaataaagtattacctagttcggtaaataaaaaaaaccgttctgtgggtaatctcttttataatgtccaaaaatatagggacggttttggtataaccagagctgtcctgtttctattttcacaggattgctctggtcaaggagcaatttgtgattctaagtaaaacaggcagtctataccaacaaccgaatttattccgtttttttctcagtacatcatcagtccttgaacatgaattaaaaactcatatatcagatgttttaaaaacagtctatttgttattgatgcaaataggctgttttcatatttacaaaaaattttttcaatcctgcaacaaatcacaccctgccgtacagatatggtgcggaaagagggatacatacttttcactttatagagaaagggggtgtgattttgaaaccatcagacttccaaaagacaatacagtgtcagtttgactgtaagctcaaaaaggttgtgaaaggcattgcccgtaactaccgcaaggaattagccagacgacaggcaaaggaagtatccttttgtgagcttccagagattgttgttgagaaattgattgtatgggacgattacgaaagtgaatatacaacattcgatgtgtgcggtacagaaatccgtgtacttgacgaagaacttgcagaagcactgaaacagttgccggagcagagccggaacattgtattgatgtttttcttcttggatatgagtgattcggagataggcgaaaagctgaacattaaccgaagcacatcatacaggcacagaagaaattcacttgaagaaatcagaaagcagttaaaggagaagaaaacaaatgaagaataagcaacacacacttccatcattttttctcatatcatcagccgtagacggtaacgaaaacgccatagaaaagctgttgctgttctatgaagcctacatatcaaaatgttgtttacgcccattttatgatgaatacggtaacgtatacattgtggttgatatggaattaaagggacgtatcagagaagcccttttgaaaatgatatgtgaatttgaaatagacgaacattaagtaatatttgagcggagcatgatttaacaaactcccctctttcctgttccgctttttcttatcattctgtatcagtccatttgcaaaaatgaattgatacaggctgacaagagcctaacagttctttgacaagtgaataaagcagtcagatacgtttgtgcttgcagtgagccatcagaggttgtacgccgtgactttcccaatcgggagatagcgattcatgcaatgatctgggagcgaccgttggaaaagtcgttctgccatgacctgcaacacaggataatgatacacccgtatgacacggttcagcccacaggaatgggaatggttgagataccagcggagcttgccgaagccgtctgattgcttgtaaaaagcacatggtaaaggagaatgatacttttactggtgtgtagaaaatgacgataatacaggtcggtaaaaggagggctgacagatgaacaaaacaaaagaaagaccaatctcacagccgataacggtaaatatagataaattgtctgcaatgttatcttgtggtcatgctactgcaagaaagattggagaacaggcaggagcaaaaattataattggacgcagggttctttattcggtagaaaaagtcaaaaattacctctcatatctggaagaatagcaccctttttcatttatgtttcttgtgatatatggtataatatttatagacataaccacgtcatgagaacaaaaaggaggctattacagaaaggaatgtttctcatggcaaatagcagaaaagaccataaaggaagaaaattaagagagggcgaaagctggcgtaaagatggtagatacagttaccgttatacagatataagaagcggaaaacgtctgacagtatatgcaaaggatttaccggaattaagggaaaaggaaaagcagattgcaaaagacttggaagataacattttaactgatggagcaatcaaaaaacttactcttaataaattgtttgaaagatatatgtctactagggagctgaaagaatctactagagcaaattatctgaaaacatgggagaatcgtgtcaaagatgaaattggaaacatcagggttgttcagattttaccatcacacatcaaatcattttactcaaaactttctaaagcaggatatgcatattctacaataaaatttattgacaatatgatttgtccggcactggaaatggctgttgatgatgatattatccgcaagaatccggcaaagttttctatcagtgattatggtagacaggcagaagaacgtattgccttaacagttttacaacaggaaaaaatgctggaatttgtgaaaaataatcaagtatacaacacctattatccaatgcttagaatcatgttaggaacaggtgtaaggtgcggagaactgattggattgacttgggaagatgtagatggcagaacaaaagtggtaagtattgaccatcagttgatttataaagatttaggagatggctataaattccatatttccacgccaaagacagattctggaatccgaactatccctatgacatcagatgtacaaagagcatttgaagaacaaaagaaattaaacttcatgcttcaaaaaggaaaagatgttgagatagatggttataaaggattcatttttatggcgaagtccggcagaccgctcatgcctaatgcgataaacaatatcttatataatattgtagacgcatataacaaaaaagaagttcaaattgcaaagactgaacatagaaatgctgaattgttaccaaaggtatctgctcacattatgcgacatacggcttgtaccagaatggcagaaaagagaatggacgtaaaagttcttcaatatattatgggacacgcccacatagacgtaacgatggacgtatacaaccatgtaagtgagatgtccagaattgagagtgaaatcacaagactggaaaacgtagcaattagctgacaccaaaaataaaaaattggtgtcaaaatggtgtcaaatcaagaaaaagtgatgattataaggaagaaaaagtgttgcaaaccccgtaaaatcaaggtttgcaaaaaaaatctcaaataattagcactcacctattgacagtgctaataacgcgtgctatagtacagatagaacaaaggaaggggaacgaaaagaaaggttcgccagaaagtgttccgaacgtattatgagtgtttgaaaggagacaggacttatgttaatgcctagtatttttaataataatttatttgatgatgattggtttggatttccgttttacggatatgcagataaagcagagaacagagcagaaaagaagctctatggacatcatgcgaataatctgatgaagacagatatcaaggaaatgaaagatggatatgaacttgagattgatcttccagggttcaagaaagatgaagttactgcagaattgaaagatggttatctgacagtcagtgcagcgaaaggtcttgatcaggatgaacaggagaaagaaaccggcaggtatatccgccgtgaacgttacgcaggagcatgtcagagaagttactatgttggtgaagatatcacagaagaagatatcaaagcagaatttaaacatggtattctgaaactttttgttccgaaaaaagaagcaaaaccagcggtagaagagaagaaatatatcacaattgaaggttaatatagaagataaatttcccccggagagcaatctccggggtgttttacaggcaggaggtgacagagcatggcagcaaagcgggattactacgaggtgctcggagtagcaaagaatgcagatgagaagacaatcaaaaaagcttaccggaagctggcgaagaagtatcatccggataccaatgccggaaatccggatgcagaaaagaaattcaaagaagtaacagaagcttattcggtactgagtgatccggaaaagaagaagatgtacgatcagttcggacacgctgcatttgaccagtctgcaggaggcagctatcagggcagtggatttggaaatggtttccagggattcaaaagtggtcctggaggatatcaggagtatcattttacagaaaatgcagatgatattttcggagatatgtttaaagatatcttccacggaagcagcagtaaaagcacagatggtttcggaggtcatggttttcacagaagcagtttctatgacgatggatccggatttagtggcttcggaggatttggcggtcacggatcagcaggctttgatcagaaaggtcaggatttgaatgccagtgtgtctgttacatttgatgaggcagcatttggatgtgataaaagaattactctgcaggatcagagcggaaaagcacagacacttgaggtgcatattccggcaggaattgacagcggaaagagcataagacttcgtggaaaaggaatgccgggaaccggaaaaggtggggcaggagatcttcttctgaaagtaactgttcagccgaaagccggatatgaacgaaaaggtatggatgtttatacaacggtcagcattccttatacaactgctgtgtttggtggagaagcaagggtgcataccctgtatggtgatgtgatgtgtaagatcaaagaaggaacacagtcaggaagcaagattcgtttaagaggaaaaggaatcgtttccatgaaggatgcaaatgtccatggtgatcagtatgtaacggtacaaattcaggttccgagacatttaaatgcagaagcaagacagaaactgatggaatataagaaagccgctgccggaggaagataaaggatccggggcgtttcatatagatgggactcataaaatgagttcgatgatttgacagggaagtaaaaatttatatagatttagcactcgactattgacagtgctaataccaagtgctatagttcgagtagaacaaagatagcaaggcaaaggagggactcatgttatgaatatcaataaatttacacaaagttctatggcagcagtacagaaccttgaaaagattgcggcagattatggcaaccaggaaattgaacaggaacatcttctgtattctttgcttacaatagatgacagcctgattctcaagctgattgagaagatgggcattacaaaagagacgatgatgaaccgtgtggaagagcttttacggaagcgtccgaaggtacagggcggtcagatgtatattggtcagaatctgaataatgtgctgatccatggcgaggatgaggcaaagcagatgggtgatgaatatgtatcggttgagcatctgttcctcgcacttctgaaatatgcgaaccgtgagatcaaaggtatgatgaaggaacttggaattacaagggaaagtttccttcaggtactttcttcggtaagaggtaatcagcgagtaaccagtgataatccggaagctacttatgataccttgaacaaatacggggaagatctggtagaaaaagccagggagcagaagctggatccggtcatcggacgtgatgcagagatccggaatgtgatccgtatcctgtcacgtaagacaaagaacaacccggttctgatcggtgaacctggtgtaggtaagacagcagcagtagaaggtctggcacagcgtattgtgcgtggtgatgtaccggaagctttgaaagataaaaaagtatttgcactggatatgggagcactggttgcaggtgccaagtatcgtggtgaatttgaagagcgtctgaaagcagttctggaagaagtcaagaacagtgatggaaacatcatcctgtttatcgatgagctgcataccattgtaggtgccggaaagtcagacggtgcaatggacgccggaaatatgttaaaaccaatgcttgcccgtggtgagctgcattgtattggtgcgacaactctggatgagtatcgccagtatatcgaaaaggatgccgctctggaacgtcgtttccagccggttatggtggatgagccttcagttgaggatgccatttctatccttcgtggattgaaagagcgttatgaagtattccatggtgtcaagatcacagacagcgcactggttgcggcggttactttgagtaaccgttatatttcagaccgtttccttccggataaggcaatcgacctggttgatgaagcatgtgcatccattaagacagagctggattctatgccgacagagttggatgaactgaaccgtaagatcatgcagctggagattgaagaagctgctttgaagaaagaggatgaccgactgagcaaggaaagactgcagaaactgcaggaagaacttgccgaagaacgggaaaaattcgcaaagcagaaagcacagtgggataacgaaaaacattctgttgaacatgtacagaagatccgtgagcagattgaacagctgaaccgtgaaatcgaagcagctcagaggagctatgatctgaacaaggcagcagagcttcagtacggacgtcttccacagttgcagaaacagctggaagaagaggaagcaaaggtaaaagatgaagatctgtcactggttcatgaaagtgttaccgatgatgagattgccaagattatttcccgctggactggtattccggttgcaaaattaaacgaaagcgagagaagcaagacactgcaccttgcagatgaacttcacaaacgtgtcatcggacaggacgaaggcgttacgaaagtaaccgatgcaatcatccgttccaaagcaggaatcaaagatccgactaagccgattggttccttcctctttcttggacctacaggtgtaggtaagacagagcttgcaaaagcacttgccgagaatctgtttgatgatgagaacaatatggtgcgtatcgatatgagtgagtacatggagaaatattccgtgtcccgtctgatcggagcgcctccgggatatgtcggatatgatgagggcggtcagcttacggaagccgttcgcagaaaaccgtattccgtagtgcttttcgatgaagtagaaaaagcacatccggatgtatttaacgtacttctgcaggtactggatgacggacgtatcacggactcgcagggacgtaccgttgatttcaagaatacgatcctgatcatgacatcgaacatcggatcttcatatctgctggatggtatcgatgaaaatggcgatatcaaaccagaggcagaggcgatggtcatgaatgatctgagagcacatttcagaccggaatttctgaaccgtctggatgagacgattatgttccgtccgctgacgaaagacaatgtctactctatcatcagcctgcttgtcaatgatatcaataaacggcttgcagataaagaactgaggatcgagcttaccgaagcagccaaacagcttgtagtggaaggcggatatgatccgacctatggtgcaagaccattgaagagatatcttcagaagaatgttgaaaccgaggcagctaaactgattctggaaggaaatgttggcagcggagatacgatcctgatcgataatgtggatggaaaacttactgcaaggatcaagcagcacttaagagaagtataagaaatgtgatatataaagaatctgcaattggcagatcatcgaatccgatcatggtgatatcatcaggcgcaggacggtttatgaccgcttgcgcctgtattcgtttggagtcataccaaactgtttttgaaggcagtctgaaagtggctctggcttgaaaaacacaaaaaagtgctgattgtactaatcggtttattcgtgaactgaagcagacgccgtcccttctcgagcttgcatcggagaagaaaatggcttcttcaatcacataatcgcgatacaagctgataaagcaaaaaaccggatacaattttcaggagcttctgcaaagaaaaagatttcagatgacggttcttctgttgtgcgatacaaagctttcgattgaaaaaatagccctggattgtcgggtatgagaatcaaagctatttttcaggcaattgaatattacggtgcggcagagccgccagtccggtgtggcgagagccacctgtccggactaacggagccacctcagttgaaccggtgatcgtggcagcagatgatctggtaccgagtgagactgttcagctcgacaagtccaaagtgcttgcatttgcaaccatgtacggatcagcaaattcccatacggcaatccttgcaaggaccatgaacatcccggccgttattggtctgggagaagggcttgcaaaagaatatgacggacatatggcagccatcgacggctttaccgggaccatctacattgatccggatgaagagaccatgaaggctatgaccgaaaagcgcgaagaagaccgcagacagaaaacacttctggaagaactgaagggcaaagagaatgtcaccctttccggacagaagatcaatgtctatgcgaatatcggtaatctttccgatgtgggagccgtacttaaaaatgatgcaggagggatcggacttttccgaagcgagttcctgtatctggaaagtgaagatttcccgaccgaagaacagcagttccaggtatacaaacaggttgcagaaaatatggcaggcaaaaaggtcattatccgtaccctggatatcggagcagacaagcaggtggattactttggacttgacaaagaagagaacccggcactgggataccgggcaatccgtatctgcctgacaagaccggagatcttcaagacccagcttcgtgccctgtaccgggcatctgcttacggacagatcgccattatgttcccgatgatcatttcgataaaagaagtgaagcagatcaaggtgatcatcgaagaggtcaaagaagagcttcgtgaggcacagatcccgttccgtgaggatgtggaactgggaatcatgattgagacaccggctgccgttatgatgagccgtgagatggcaaaagaagtggatttcttcagcgtagggaccaatgatctgacccagtacacgttggcaatcgaccgtcagaaccagaagctggatgccttctacgatccgcaccacccggcagtccttgcaatgatccgcatggcagccgaaaatgcccacgcagaaggcaaatggatcggaatctgcggcgaactcggagctgacctcgaactgaccgaagaattcttaaggatgggattagacgaattatccgtatcccctgcaatggtacttccgctcagaaagaagatcagagagagcaaatagttgcggtatacagctactatgaacagtaatagcgaacaagagttagaaatcagagagaaagtaatgtgtttactttctctcttttttttgctaaaatattctctgctacaagaaaattgtacgaggatattttaaggagtgagagggaatatccgagacagacagcaggaggaaaacaatatgttgaaaaaggtgtttaagcttaaagaaaatcacaccgatgtcaaaactgagattcttgcaggtattacgacatttatgacgatggcgtatatcctggcagtcaatccaagtattctttccgcagcgggtatggatcagggggcagtctttactgcaacagcacttgcatcactgatcggtacgctgtgtatggcagtattcgcaaattatccatttgcacttgcacctggtatgggactgaatgcttactttgcttatactgtagtaattggtatgaactactcatggcagactgcactgactgcagtatttgcagagggtattatttttattattctttccctgacaaatgtcagagaagcgatcttcaatgcgatcccaacctgtcttaagacagcagtcagcgttggtatcggattatttattgcatttcttggacttcagaatgccaatatcgttgtcggaggatctactctggtacagctcttctccgtagatgcatataatcaggcaaatggagtggaagcaagcttcaataacgttggaattactgtacttcttgcaatcataggtgtgctgatcacagcaatcatggtgattaagaacatcaaaggaaatatcctttgggggatcttgatcacatggatacttggaatcatctgccagatagcaggtctttatgtaccgaatccggagatcggattctacagtctgcttccggatttcagttccggacttgcaattccaagccttgcaccggtatttggaaagcttgattttaagaatgtattttcactggaattcgttgttgtagtatttgcattccttttcgtagatctttttgatacactcggaactctgatcggtgtatctacaaaggcaggcatgcttgacaaagacggaaagcttccgagaatcaaaggagcactgatggcagatgcggttgcaactacagttggagcagtacttggaacttctacaacaacaacattcgtagagagtgcttctggtgtaacagaaggaggacgtacaggtttaacatccctgacaacagcgatcctgtttggaatttcccttttcttatcaccaatctttcttgcaattccgtcctttgcgacagctccggcactgatcatcgtcggcttctatatgctgagcaatgtggcaggaattaacttcagtgattacagcgaaggaattccgtgctttatctgtatcgcggcaatgccattctgctacagtatttcagaaggtatttccatgggagtgatttcttatgtagtaatcaacgtacttacaggaaaagcaaaagaaaagaagatcagtgtactgatgtatgtactggtgatactgtttatcctgaaatatattttcttataagatgaggattgcgggaattgtttagcaatggagcaatctgattacaccagtgagcggcaaaatttatttttgacactcacatcataagataaaaagaatatggggatatgtgaaagcacagggactgtccggtaacggataggattctgtgctttttgcgtgtcagaatcggtgccgggtgagatactttggattgactagcacccgtacaaattgctataatggaaaaagacaaaacagagaatcacaggggaaaatatatgaatttactgacaatggaacatgtatccaaagcctatacggatcgtgtgcttctggatgatgtgggatttggaatcaataaaaatgaaaaaatcggtgtgatcggagtcaacggaatgggtaaatccactttgctgaaaatcgttgccggaatcgaagaaagtgatgccggaacgatcagcatggggaatcaggtgaagatctgctatcttccgcagacgccggtatttgaagcaggaacaacaattcttcgcgcggcaacagaaggaaattatgatgagctgaaccgctggacgatcgaggcagaagcaaagtctatgctgaatcagcttggatttaccgattatgatgaaaagattgagcatatgtccggcggacagaagaaaagagtggcacttgtccgggcacttttaacaccggcagacattctggtccttgacgaaccgacgaaccatttggataatgagatgtccgaatggctggaagaatatctgatccagttccggggagcgatcctgatggttacgcatgaccgttatttcctggaccgtgtggtaaatcgtatcgtggaagttgatcatgggaaattatataactatccaggcaattattccgagtttgtgcgtctgaaagccgagcgtcagaacatggagcttgccacagaacgtaagagaaaaagccttttgcgtacggagctggaatggctacaccgcggcgcaagggcgagaagtaccaaacagaaagcgcatattgaccggattcatgctatgcaggaaatgaaagatattcaggaagaaaagcgagtaatgctggattctgtggcttcccgtatggggaataaaacaatcgaactttccgaaatctgcaaatcttatggagaaaagaagctgatcgaagatttctcttatatttttctgaagaaagaccgaatcggaattattggacataatggatgtggaaaatcgacgctgctcaagattatcaacgggatcataaaaccggatgtcggaactattgaaattggacagacaatcaagattggctatttctcgcaggagaatgaatatatggatgaatccgagcgtgtcattgattatgtaaaagaagcaggtgagtacattgcaacttctgacgggaagattaccgcgtcccagatgctggaacgatttctttttgacggggcaatgcagtggtcgaggattgaaaagttatccggaggcgagaaaaggagactttatctactacgtgttttgatggaagcaccaaatgtattgatcctggatgagccaaccaatgatctggatatccagacgctgacaatcctggaggattatctggatcattttgatggtattattctgattgtatcccatgaccggtacttcctggatcgtactgtcagtcgtatttttgcatttaatggaggtggaaaaatccgccagtcggaaggtggatactccgattatctgatccgtgtggagcttgaaaaaccgaaagacggacagacaattgcagaaaatatgtcagatgcagcttctgcacagaccggtgagtctgacagcaaaaagacctggaagcagcgggaaaaaaagctgaaattttcttataaagaacagcgggaatacgagacgatcgatgaggatatcgcaaagctggaagagaagatcgaaaagctggatcgggagatggttaagaatgccaccaattccgtgaagttgtccgaacttatgaaagagaaagaagaaacagagacaacactggaagaaaagatggacagatgggtgtacttgaatgatcttgctgagcagatagaaaatcagtaaagtgattgacagatttacagatgataaagtataggtagtgagaatcatatcaatgtattcgaaggaggagaggtatatgatgtggaatagagcagaacttaaaatgagaggcaatatagcatttaagaagaattatgtgtcagccgttgtagttgcgcttctgatgggaatctttggcacagtctctggcgaatccagtgcaagacgggtaagtgagaattcagatatatatagtggaaatttatttaatgtgggaatgattaccggattgcttgcaggaatcgcaacggtagtaatactgattgtccttgtggcaaaagtatttgtaggtaatctcctgaaaatgggtggataccggttctttatcctgaaccagactgcacagccgggaatcggaacattgcttgacggtttccgttccggacattatgttaatattgttcttaccatgtttttaagagatttatttactacactttggagcctgcttttggtggtacctggaatcgttaagcattatgaatatctgatggtaccatatattattgctgagaatccggcaatggattacaaagaagcatttcagatcagtaaacagatgatggatggagaaaaaatggaagcatttatcatggatctgtcattccttggatggtatctgctgagtgcggttacctgtggacttcttgcaattttttatgtaaatccgtatgtacaggcatcctttgcggagatgtacacattcaataagcagaaggcttatcaggagggatatatccggtaagagtttcagaaggataaattttaaaatgtaagaatagagcgcagacgctggcttaaaatgaagcgtctgcgcttttatttagtgggcggccttctccgcaaaggtggtcgtaactagttcttcataaggaacacgctctttcagctcaccggagttttccagaatatcctgcagcagattgaagctttcttcgttgaagatcagatccgatttccaggtgtcttgttcgtagtaacggctgacaatggttgtaattgtagcgagatcggtttccttgaactgtggtgcaatgacttttgcaatctcttccggagtatgggactgaacgaaatccattcctttttgcagggcattggtgaatttctggatgatgttcggattagcattcagataacttgttttggcactataggcggtgtatgggacatagccggaatcaacgccgagagaagcaacgacataaccggaattttccgcttcaagggcagtagcgctcggttcaaattcgatggtatagtctgcctgcccaccggaaaatgcagcagcggttgaaccgaaatcaatactctggttgatagaaagatccttctgtggattaattccgttttttttcaaaatgtattcaaagaccatttccggcatgccaccttttcttccgccaagaacgtcttttccttttagatcatcccatgaaaaatccggcatttcttcacgtgcgaccagaaagtttccagcgcgctgcgtaagctgcgcgaagtttttgatgacatcatttgcaccctcctggtaagtataaatcgaagattcacttcccataaagccaatatctgcctcaccggagaggacggcggtcataactttatccgccccaaacggagtcaaccagttagtacaagacgctataagaaatcaacagagtcgacagtatgatcagtgttcaggtgaatctcccggataatagaatgccagaaggctctgcggttttcttgggttaaattgtagtacattgttctaaagtctgtattcagcagctcttccagataagcataatcaggttccaattccggagccgtatttaacaattcattcagttcgttttcaatccgatcatattctttgctgtaataatcccattcgattcttcctttctggaagagaagatttaatcgttctaattctttctggagcttttccggagtctgaactttcttctttttttcttgttccttttcaattttttcacattttattttaaatttattgtattcgtattccagatgatcaatcaggtatcgttctataagattctgactaaccatatgtctgtaagaacatttatgatcgatgaaagctttattgcatcggtaatagcagtatactttttttgcaccggttttcctgttgataatggacgaaccgcctcttgcgctaagcctgcgcccacagatcggacaatttatcatgccactgaaaagataaatccggccagaaggagcacgcttaacatttgcgttctgtatttcctgcagattgttccattcagattctgtcaggtaagcagggcagtatggaatcccgcgataggttcctttgtaaaattcactcgacagcagtgttcgcatattcgcccatgtaaaatccggatcataattttcctgaatatagcgcatggaaagcccttttgcatggtgcttaaagaaaaaacgataaaaggcatttacagtgtcttcccgatctggatcttttaccatgcgttttactccatcaatgattccagatttgtagccgtaccccatattcacatcaccgaagatcagttttccctgccggatagatgcttcatttacgaatttgatacgttcgctggtagtatccacttcattctggccaatagatagaactacattcagctgcagtcgaccgtctctggtttccatattgattccaggttcactggtgctgatccaatggacgttattatcgtccaagacttcctgtaccttgtaaaaatcagacaggttacggaaccatctgtcaatccgccagaagatgatcacatcaatttttccggcttttacatcttcgaggagtgaatggatagcttttctcttttttaattctttacgggcagttttaccctcgtcagcataaactccagcaacggtcatattatgttctttggcgtaattggtcaggtactgcttttgtgcttccaaggatttaccgtgcatcatctgttcagcggtagacacacggatgtaaatggcgcagcgttcaattttacttggcatattatatcacctttctcttcaatatacgtaaaaatgagtataaaaataacagccagagaacttttgttctcttgcgtggctgttccgaagatgatacaatattatttggaaattgggtatctcttcggagtacttaatgaaagaaacatattggagtatgtttccatcgctcgaccgttcctgttggcgcaggagcggttttttgttaattattcatttaaatgtggtgaacagcattttttacaaggaatatatcctaattctatagcatgattaaatgaaattttctggcaattaatagatccactacaatgaggattagtgtgatatttttgcgtttttcggttaatccaaatataattttctacttttatatgtagtccaagagcctgttctaatcgattgatatcattcggataggaatgacaatattcattgagtgaattgttgatagcatgttgtaatcgattgcatggttgtttgaattgaaaacaattaagtgcgaataataaccgagaaattccattatatgtagttgctttatcagcacgtaaacgttgcttggcagagaaattatatactcgcccaccgtgtgcggctaagtttctgtattctaaacataggaaaagggtatcggaaagtagatccttgtaatactcttcgttttcgtcagatactgtgtttccatacaattctcgaattaaaatgtcacgctgtttcttttttaaaaatcttatataattgaccaatgtaccaaagtatgcacctttaaggagtatccatggaggtacatagccatatttattcctatagtattgaataggctctttattggatttttcagccaaatcaaaaagcgtttgtaaaattctatctcttctaaaataagagtcagaaacttttttatctcggtaattatttttctttagatactgatggtgatctatgccgaaatctttacctataatattagcaacaactgcacgaaggtgttcttcgatgtctatcatagaaagcagaacagcattgcgtagattgtgatctaaagtaaataatgcaaaaatttgttcgaatgttacgccaggattatatcttttttcgccgtataatcgggtgatgtaaggatctcggtaaccattgataatattatagtaaccataggtagataattttgccattgcaacagatttgtcgataattgtaagttgttgttttttaagtttttcaatctgttcttctactgtagtatatacataattgttcatgtgcaactcctttgtatacaaaaagagcccgagaaaatctcgaggctcttttcgtgaccggataccagccatttcactaaacagtgatattatatcatatgtaaaaatgatgtcaagtattcctcgaaaaaatattataatttcattatgttccatattcacataaggcatattttctaatatttatgttattctgcctgctcaagcgctatagtttttgttattccagaaactgttacctgataggtaatctgcttgtttgaatcggaataagaaaactcttttgtatcatccagagaggcgagaagagcggaatcggttgcttccctatttctggtggatgtccaagtgtattcttcagaatattctgtaggagcagtataggttccaacccagtaaacagcagtcgtgtttccttcatccatgatccagtttattgtgatggtatcttctgtaatatctgcctgcatccaagtaccgtcatcatctttgtactcccattttccagtaagcacaacaggatctttgacttcttcctttacttcctcttttggagtttcagcagatgcttctgttttcttggatgattcctttgcttcttttgatgaatcagagctattgccacaggctgtaaatgacagtgccatacttccgatcagaaccaatgctacaagtttctttttcataatttttcctcctcatataaagtgtttctatataatcgcatatgcggttataccaatttcatcatcgatagctgtggtataaaatacaccacataattatctaaccgcttacaaatcccgtacttattcctgtaacattcaatacattcttccagaaattcttctgtcacttccaggtattcagcgatttcaaaccggttctgacagccatgctcaaaggctcgtaccagtccgaacagaccgatctgcttgttgtacgcccaaaatcttgcctgacgttcctgttttcggttggcagcagatgtcatatcgaggatatttccgacagatgtttcgtgatgcccgagttcttcggcaagagcacaggtcttttccggaatggtcatgtcttctcggatggctacaacaccatcgcaatacagtccttttatgttattgctttcaaaacggtaatttaaaacatcgacaccatcttgataagctacgtcttccaattcttcaaatttattcaaattagcacctcccataagtaaatttatagccatgagcaaaactccacacattcagtatttatgcgggtttgcgaggcatggcaacctcattaatcacttcaaattcagcttttattttagaaatatgataaatcagggattgaccttgctggattatatgcagcggatcaatccctgcttctatttaacaaaacggtatccaatccagccagattctgctatactgtataagaaaatcaaatagaaagggtggaacgtatgatcacattaaatgactatttatattcaggtgatacgatttttcggattttaagaaattatacagtggatctgaagaaagaagcaaagaagaatcacaatgaaatagatctcatccattccaatttcctgatccagttcagggaactgcttgaacacaatgatttccttactgcacagtcgcagaaaatcagggatttttataaatacatggtacaggaatatcctctgcttgcttttacttttaaaggaaggatcaagtccctgatccgcgcagaggaaaaattcaacgggtatattgtagaatatatttatgattattatgaaaaacatcatacctatccgccggtgcctgacctaagggaaaaactgagctgctttcgggatattatcgcataccgtctggtaatttctcttccaaaatgccatatcagggatgacaaactgcgagaagaagaggaaatcaagtatttatacaggatcgcgaatgttcttccggggtttctggaggaaagaggatttacggcagaacctgcaaaaggggtgcttgaaagtacatctccttttatggatgaggcggtgaaaccttattatcgggattatatttccaatggaagcggaggcagctatcaatcactccacatcacgttttatgataactgttcgagaagttacatggaagtacaactgcggacaaagaagatggatgatatagcggagattggagcggcaaatcaccaggcctacgagaaggaacaggaaagagtcagggcaagaagagaagctattccggaaggagaatgcatttattttgatgaggcatacgaaagaggaatgcggcttctggggttggaactgaaggatctggaagtcaatatgtttgctgcggcaaataatagtctcatcaatgacggatgcggattatacagggggagactgatcctgccgtatgaacatttatcaagattccagacggatctgaacgattaaaagggttataagaatgaatacatcagatacaaaaaaagcatattaccatctccaggtcagagaagagttgtatctggataatatgccggatctcttttgagaaaagaatgaaaaaagaagagagggtaaaaaatggaagaaaagaaaaaacagacagaatcggaagcctgtaaagtggcaaaaaaatgcggaggatgccagtatcagggagtgccatataaggagcagctgaaaaagaagcagaaaatggtgaacgctctgttgtcaaaatacggaaaagtagaaccgatcatcggaatggagaatccgtattattacagaaataaagtacacgccgtattcgacagagaccgaaagggaaatatcgtatccggaacctatgaagcgaagacacacagggtcgttcctgttgaaaactgtctgatcgaagacaaaaagagtcaggagatcatccggacgatccggggacttttgaaatcttttaagatcaaaacttacgatgaagatacaggatatggcctgttccgtcatgtgctgatcagaagagggtttaaaagcggagagattatggtggttctggtgcttggatcaccaatccttccatcgtctaataatttcgtaaaagcactcagaaaagaacatccggagattacaacggttgtccttaatatcaacgacagaaagaccagtatgatccttggggagagagaaaaagtgttatatgggaaaggatttatccgggatgaactctgcgggtgtactttccggatttcaccaaagtccttctatcaagtaaatccggtgcagacggagatcctttatcagaaagcgattgaatttgcacatctgacagggaaagaaatcgtgatcgatgcctattgcggaatcggaacgatcggtctgatcgcatcgggacatgcaaaagaagtagtcggtgtagaacttaataaggatgccgtgaaggatgcaatattaaatgcaaaagagaatcagatccggaatgtgagatttttccagggagatgccggggagtttatggaggcgatggcagcagagggaaatagtatggatgtgctgtttatggatccgccgagagccggaagtgatgaaaaatttatggcatctgcagtgaagatgggaccggagaagatcgtgtacatttcctgcaatccggagacactggcaagagatctgaagtatctgacaaaaaaaggatatcaggtaaaaaagatacagccggtggaaatgtttgcgtttacggagcacgttgaaaccgtcgtactcttatcgcgataacaaaaagattgatgaaaaaaagcagaataagcgttctgcttttttgtttttagtcaaatgtcaacatttaacaatttgttaaaaatgcacaaattgtagactgttaacaatttgaatgtgtgtgaatgaaaaacagataacgccaatatatgtagtaaaatccgtccatgaaagaattgtttttttgtatacaataaaaatacgtcgtatttcacaaaaatgcacaaaaacgaaaacgataatagatgtttaattggtaaaatgttataattgtcttaacacaaagtttacatttatggaggaatgcaaaatgaaaaagagaatgatagccctcatgctggctggtatcatggtattctcggtcacagcctgtggcggtggaggagcttccagcaagaaccagaataatcaggatgatggtgaaagcaaacaggttggagttgaggtaaccgaagatatgcagagtgcaccgccggaagatgcacctgtaggaggacaggttgtagttgcaatttcaccaggtaccttatcaccggatatgtacggcggatggacaaatagtgcaacgaactctggatttatcggactgatgagtggttacgccctcgctgattacaatcgtgattatgttcttgattgggacccggttgttgttaaagatcacgaagtaatcgaaaacgatgacggaagcaagacataccgttttgaaatcaatgataacctgaaatggagtgacggttctccgatcacagcaaaagattatgtattcagtcttctgcttcattcttctccggaatttgcagcctgtgaaggtgatgcaacatacggatgggctttagttggatacaacgatcatgtacagggaacaacaaaagaattcgcaggtgttaaccttcttggggattacgaattttctatgacaatcagtgcagatcagcttccgaactactatgagatggcaaatgttgcctatggaccggaaccgcttgcagcaatcgctcctggatgcgacgtgaaagatgatggaaacggagcataccttacagacggatttacagaagatctcatcagagaaaccttgcttgatccggataaaggattccgttacaaagcaccggttgtatgcggaccttacaaattaaagagtgttgaccttacaactgaaactgttgaacttgaaatcaacgaagaataccttggaacatatgatggaacaaaaccacatatccagacaattatttccaaaccggttgcagatgaaacaatccgtgacgaatttgaaaaaggaacaattgatttctactcagcaggtacaggagaaaagatcgaagctgctttaacaaaagtagaagaaggaaaattagatgcaaactatggtcttgtaccgggaacacgtatcaacgagatgcgttatatgtgtgactttggaccgacacagtttgaagaagtaagacgtgcaatcgcttatatcgtagaccgtgatgaaatcaacaaacagttaacaggcggatacggtacagtggtagactgttatgcgacagatgctacagcagattttgcagcaatcaaagatgatattgaatctgaactgattcactactcatatgaccttgataaagcaaaacaggaactcatcgatggcggttggacactgaacgaaaaaggtgaagagtacaaagaaggtacagacaaataccgttataaagaagtagatggtgaattgatgaaactaaaagttgaagtagcatgctgtgaagatgactactcaaaactttacaacacagtaatcccaccggaagcagaaaagatcggtatggaatacaaatacacatctatggactttgcacttatgatcaaccatttgaatcgccagggtatcgatgaaccagaatataacattttctacagtagtatcggaattccggaaattctcttctactggaactgcttcgatgacgatccgagtttaatgggaagctggaatgttaactacatttccgatccggaattaaaagcaatcggtaaagagatgcagaaagttgatcctgaagacattgacggatttaggaaattatatggaaaattccagctggcatacaacaaaaaacttccaagtcttccaatgggatcaggagtttcttatatgttcttcaatccgaagcttaagaatttcgttcctagagctcatgtgggatggggagcaatggtattagatgcatactttgaagaataagcataaaggattcatcagaatagatcaattctattaacttttgatatgcatgacaaaacagggaggacagaacaaaggcaaatgttctgtcttcccgtatcttttctttatacgaaaacaaaattatggtaatggttcggacagaatcacatgtcatgaataattcaggaataactatttcatccagaaggagaaaactacattatggcaaaatacatattgaaaagacttggttatattattatagtattcttcctgctttccatcttactgtttggtatttttaaaatggtacctggtgaccctgccagacttatggtcgagggacaaaagcagagtgtttcaccggaacagtatgagatgctttatcaacaggcaagagtacgtctcggacttgataaaccgattccggttcagtatttaagctggatgggaaatatcttacagggagatttcggttactctaccgtatatcgtattccggttaaagaactgatcggacctccgatgaaaaatacaatcgccctgaacgttgtatattatattttccttttcgcaatcggaattccgctgggaatcaaatgtgcggtaaaaaaagacacggtgtttgatacatcactccaggtagcaactatgatcggtatcagtattccttcatttatttcggcgctgatctttatctacctgtttgcaattaaaattccgatctttccaatcagtggaatggtcacaacgggtgcaaattttacaggcttccgtgcattcttagattatttatatcatatggcacttcctattattgtatgtctgacaggtatcggtggtctgatccgttatgtcagaggagctcttcttgatgcattatctatggattatgtaagaacagcccgtgccaaaggtctgaaagaaaaaactgttatttacaaacatgcgttccgtaacgcgatgatcccgatcacaggctggatcgtaggctctatcgtaggtatctttggtggagcggttatcattgagactctgttctcatggaaaggtgtcggaaaacttctgatcgattccttgaaccagcatgactatacagtcgcactgtccatgcagatgttttacattttgttaggacttgctgcaaacctgatcacagacttatgttactgtatcgttgatccaagaattaaactcgattaggaggaagacaaatgttatttggaaagaagaaagaaaaagagcagcgttccgttcttgaagaagaacagatgcaaagtccttttcgtacgattataaaaaatctgctggaaaacaaactggctatgggaggattgatcgtatttgtatcaatttttgcaatgtgcttcatccttccgatctggtttcaccaggatttaaactatcaggatccaacacagaaaaatatcgcaccgggattttcattcctttcggttccgtcagatttaaaagacaatgccgaagtgattgaatttggtccgacatatggtgtaggagtagacaaagacggttacgtttatgagtggggacagttaacgaaaaacctgaaaaaaattccggctgatatgggaaaagttgttgatatcgcagttggtcaggaccacgtgctagcaatcaacgataaaggtaacttatacacctggggcttcaaccgaatgggtcttaatgtgattccgccggaactgaaaggcaaaaagattgctgatattgaagcaggatatcaggtatccgttgttgtaacagaagacggaaaagttgtttcatggggaaatacaagtgcagttgatatttctacagctaatgtaaaggacgaaaaagtcaaagaagtaaaagcaaatattcagacagccattgcccttacaaaggatggaaaagtcatctcgcttgcaaagaaagaaactgctttagataatgtaccggaagagattcagggaaaagtagaaaaaatcgctttaacagataaagcagcagcagctgtattaaaagatggtactgtaaaagtctggggaaacaaccacgaccatattttctccgtaccggaaaaagtgcagggcaaagcagtggatatttcaggtggacgtaaccatcttgttgttgtgacagaagatggaaacgcagtagcctggggcggaaatgaaaacaatcaggcaaaggttcctgctaaggcaaccaatattgcaaaattagcttccggctattatcagaactgtattatcaaagaagacggctctgttgtgacatggggactgaaaggttacttacttggaacagataatcttggaagaaatgtattctaccggatcttaaagggtggacagatgactatgacagtcggattcatcgctgttatcatccagttcgcgatcggtatcttagtagggggtatttccggatactacggtggaactgtggatatccttcttatgcgtctggcagaggttgtcggatcccttccgtttatcccgctggcactgattctttcagctttgatcggaaataaagtatctgatgtcggaagaatcatcatgatcatgttgatcctcggtttcctcggatggaccggtatcgcaggtcttgtccgtgcacaggtgcttgcagaacgtaacaaagaattcgttgtcgctgcaaaagcactgggtgtaagagaaaagaatattattttccgtcatatcgtaccgaacgtaatgacgatcattatcgtacaggcaacaatctcatttgcaacctgtatgctgacagaatccggattatcattcttaggattcggtgtcgcagagccaattccttcatggggaaatatgctgaacaactgtcgttcttcagaagttatctcacagtactggtggagatgggtattcccgtcagttgtattaggactttgtactgtaagtatcaacttgtttggtgacggacttcgtagagcagttgacccgaaagcaaatgaaaggtaggaataacgatggcatatttattggaagtagatgatctacatacattttttaagacaaaaaaaggaattgtaaaagcggtcaacggtgtttcctatcgagtagagcctgggaaaacattaggtatcgtaggagaatccggaagtggaaagagtgtatcggcaatgagtatcttaaaacttttggatggaaacggatatatcgacagcggtacaattactttcaagggaagaaatcttgcggagtgtacaatcaatgatatgtaccagattcgtggaaatgagatttccgttattttccaggaaccgatgacaagtttgaacccggtatatacgatcgaaaaacagttaaatgaagtttatttaacccatcagaaaatcacaaaaaaagaagcaagtgagaaatcacttgaaatgttaaaagctgttaagatcccgaatccggaatctgttatgaaacagttcccgcatcagctgtcaggtggaatgcgtcagagagttatgatcgccatggctcttgcctgcgaaccaagtcttctgatcgctgacgaaccgactactgctttggacgttaccattcaggcacagatcttaaagctgatgaatgaactgaaaaaggaaaaagggacctctattctgttcattacacatgaccttggagttatcaaccagatggcagatgaagtggcagttatgtattgcggtcaggttgtggaaatgtgtaaagcaagaactatcttcgcaaaagagacaacctgttcacatccatatacggaaggacttatgacttcaattccacgtctggatacaccggtcggagcaagacttgaggcaattccgggagcagtacctcatccgctcaatcttccgaagggatgtaaatttgctccgcgttgtaaatatgcaacagagaaatgtatgaatgaagaaccaaaattagagttggcagaagacaatcacttgattcgttgtttctacccggataaggaggcacgccatgccaaataatgatgaaaagaaagtgcttttgaaagtcacggatctgaaacagtggtttccacttaagaaaacaaagttattccagaaagagcaggagtatgtaagagccaatgacggaattactttgaatatttacgaaggagaaacagttggtcttgttggagaatccggatgtggaaaatcaacatttggaagaactttacttcagatctacaaacagacagaaggtaagacaatgtattacggcagaactcttaccgatatggcaccgctttatgtagacgaaacaatcaaaaatatttcttctggtaaaaagaaaattgccgaattagaagcgaaggcagaagcattaaaagcggaatatgaaaaaatggaagattctgcggaaaaattccagaaacaggccgaatatgaaaatatccagaagaaatgtaatatggaattcctgaatcttgttcagatcattggtggattctatagcttagatgacacaaaagaagcagaacggttactgcttgaaaaattcaaagttgccagagtgatcagtggtttaaatgaagaaaaccagatggaaggtgtcgataagacaaaagaaatcgcagagaagaaagtggaacttgaaaaagcggagaagaagttagaagaactccgcagcaaatataaaaatgatgaagcttttacaaaatacgaagcataccgtaataatggagtagatcttgcgagactgaaaacacaagaaatgcgtttcctacgtaaagatatgcagatgatcttccaggatccatactcatcactgaatccacgtatgacagttggtcagatcatcggagaaggtcttcttgcacacggcatctttaagaaaaatgatgaaaaaatgcaggcatatgttatggaagtcatggaaaaatgtggacttgcaccatatatgatccatcgatatccacaccagttctccggtggacagagacagagaatcggtattgcacgtgcacttgcattgaaaccaagatttgtagtctgcgatgaggcggtttccgcacttgacgtttccattcagtcgcagatcgtcaaccttctgaaagatctcggaagcgaagacaatcttgcatacttatttatttcacatggtttgagtgttgtaaaatatatcagtgaccgaatcggtgttatgtaccttggaaacatcgtagagcttgcagagtcacaggaaatgtttgatcaccctacacatccatatacagaagcgctgttatcagcaattccgacgacagacgtagattctaacagagagatgatcccgcttgaaggagatatcccaagtccggttcatccgccgaaaggatgtaagttccatacaagatgtaaatactgtacagaaatctgtaagcatattacaccggaacttgtggaaatgagaccgggacattttgtagcctgtcataatccactcggagtagaaaaggattcataaaatcagaaaggaattagcatgagcttttttggaggatacagcaaacgaggaagacagttggaagaacaggataaaaaaggaagaaaagtcagctaccctcggctgcaacaacgaccagacactgttcgttccgaaatgctacggtgtctgctctaaagccagccactccatgatgtccgataatccgcatagcggcttctatgaagcggagacctcccggacactagaccgcagtggtggagatccgacctgcaatcagggcggtatctgcgtggtagagccggtcgcctttacccagaaccagagggatgaagtccgggatctgggagagaagtcagcggcacttgcagcagagccggggatgaagcagcagaccttcgtcctgcagggtaacatgatcggccgcaaggatgagaacggtccgcagggggatggcgtcaatgaggatgtctgctttacactggatgccactgaccgccatgcagtctgcgcaccggaggatgtgtatgccatgaccaccggctcctatatgcaggtggcaaaagaagttgcaccgactctgatggcacgggactacaaagacccgaccaccatcgcaccggtgccgcatctgaacgagggtgtcatgggaacggtggcaaccggggcgcatccaagcggcttcaacgggcaggatgctttcaatgaccgtctggtcatcgataacccggaagcgcagccgacacctgtgacctataccgtccgccgcttgacaccgaccgagtgtgccagactgcagggcttcccggactggtggtgccggaaccttggaacagaagatccgaccgaagaagagctggcgttctgggcagatgtgtttgaaacgcaccgcaagatcgtgacccacgccaagaagccgaaaacggagaaacagatccggaaatggctggctgacccgtatacggattcggcagagtaccgtatctggggtaacggcatatgcttagccaacgcattttttgttctggccggcatcgcatggtgtgcaggtctggaagaataaactggcccgctatattactaggtagaaagtgacccggtaatatggtgggcttacatattggtcctatttacacaacagatttcgcagtcccttgtgtaattggtcgaacatgaagaatatcgggaaatggccttgctatttaaccggttcagagtgatatatgtgctaccgaaaaaaacatcgggacgtacaaagacaaaaaacgaaaggggcaatgaattatgttgaaatttgaattgaacatagccgaccgcaagacacttgcaaatcgcatggaggagctgacgggcatccatccttactacaccagagcaccgctgtatgcgtatgacatcggcaactacaccatcgaccgggacggcaatcttctggtcgagccggagaatgcagatgccgagctgctgacgacactgctgaatgagggactgatccgcggcggcgagagcattgagagcacggatgaccagccggaaagcacagagccgactgaaaacttggcagaggagcctgtggccgaagcagagccggatgatacggcagaggatgagccggatgcagaggaatcggaaagcgaagagcagccggaagcagaagaccagtcagaagaagtaccattggatctggaacttgccttcccaaccagccagcataatggtgtgagccttcgcaatctggtcaacctcatctacagccggggccgactcatcagcaaggcaacgggcgggcactttcatgtggaaactgacctggtcgaaacactgcgggatgacagttgcacctacacggtggcaaacttcatcgaggcgcttaaaagttacgaagcacagtgcggaactgcgatggaaggtctggtgatcacagaagaaaaggtttccttcacaggattcccgacggcttccgactatgatcatctgacggctttcggtcaccttgccattctgatgaaccagcaggcgatcagccagaagcgcatccaggcaaaggatgtcaacgatgagaatgagaagtatgcactccgcacatggctcctgcggcttgggatgaacggtccggatttcaaagagacccgcaagatcctcatggagaatctttccggccatgcggctttccggacggatgaggaagcacagaagttccttgcaagggaaaaggcaaaacgggatgccctgaaagccgcgaaacaggcggcacagaacagcaatcctgccactggggaaacggccgcacaggatgcagcccagccgacacagcccgactgtggggcggatacggcgcagatgctggaggcgggagtgtaagctcccaagcccccaatgggggccggaaaataagtgagaccctcttccattgtaccgatattaactctgaaaatgtacattatcaagcagataaaccgcagaaatgtacacgatcattctgcctcatatttgtcgaatatatgttcttttatatccttgctattatccgcacctgacggtaatatgcacataccgaaagggaaaacaaggaaaaaacaaaggagaacataccatgaacgataaaacaagagagcagattgaagccatgaagaagcagaccatcggagttgagatcgagatgaacaacatcaccagagaaaaagcggcaagaaaggttgccgagtacttcggaaccagagcatggaacgccgccagcgagtacggatattacagctgggcttgcaaggacggacagggcagggtttggaaattccagagggatgtgagcatctacggaccggacgcagaaaaatgcgaactggtcaccccgatcctcacctacgacgacatcgaatccctgcaggaaatcatccggctgctccgcaaggcaggcgcaaagagcagtccaagccgcggatgcggggtccacatccacatcggcaaaggcgaccacaccgcaaagaccatccgcaaccttgtgaacatcatggcggcacacgaacagcagatcggcagagccatccggatcgacgcagggcgtaccggacaatattgccgggtagtcgaccaccgcttcctcgaccggctgaaccgcgagaagccgaccaccatgcgcaagctggaagacatctggtacgaaggcaacggttccagctgggaaaaccggaatgcccactacaattcaagccggtaccatatgctgaacctccatgccacctttacaaaagggaccattgaattccgccttttccaattcgcagacccagcggacggaaagcgtaacggactgcatgccggtgagatgaaagcctacatccagctttgcctcgcaatgagccagcttgccaagatggtcagaacggcaagcccgaagccccagcagaccgacaacgacaaatacgcaatgcggtgctggatgctccggctgggattcattggtgaggagttcgcaacggcaagggaaatccttctgcggaatatggagggcaacgcagcatggcgcaacaaataagcgccagctgtacgggcaccttttgggcgggcaaccgcccttgaggtggtagaaggaggtgcaggtttatgaaaagcacgttaaaaaatgaaagcacaccgggcggcaggacctttaaggtgaccatcaccgagacctaccagagaacggtgaccatttatgaatccgaaatgaaagagccgaccgtggaggaagcccagcgagtggcagaggactggtggcaggacagccagattgagcttgggacagatgatttccagggcgtggaattcactggcagggaggacggtgaggcggatgtttgaattgatcagccgaagcccatccagatattatcttgcctacggaagcaacctcgacatggagcggatgggaaagagatgcccctatgctgtggtggtcggcacgaccgagatcaagggctaccggcttctgttcaaaaagagcaagaccggctgctatgccaccattgagcaggacgccaatgaaagcgtaccggcagtggtctggaagctctcggaatatgatgagctcctgctggaccggtacgagggctgcccaagatactactacaagaaacagtttcagcttccggtctggaacttgaacgggaaccgcatgaaaaaggcaaagccctgcatcgcttatgtgatgcacgaggaccggcggcttggctgcccggatgccgagtattttgaactgctgcgcggcggatacagcgactgggaatttccgctggacacactgaagcgtggactggcagctagtatcggaagggcggaagccatccggtatctgaagaagcagcagatgatgtaagagcacacgatcaaaagcaaaaaacattgtgcagtatatgatgctcatcggccttgataaatcagggtagaagagtgatatataccataccgccagacaagagcggagaaaaccgaagggagagattcaaatgaagaacaagaaatattacatcgcctacggcagcaacctgtcggtggagcagatggcataccggtgtccggatgcaaaaattgcagggcaggcggtgctggcaggctgggagcttttgttccgcggctgcgccaccatcgcaccgaacccgaagaagaacacgccggttctggtgtgggagatttcagaaagagacgaaggaaacctcgacctctatgagggctacccgaattactaccgcaaggaagacctgaacatcgaactgctccgggaaggggcagaaccggagatggtgaccgcaatggtatatatcatggagaacgacttcggacgccgcgcaccgagccggtattactacaaagtcctgcatgacggctacaaggcattccacttcccgatgcacatcctcgaaggtgcgctgaaggaatgcatggataaggatgccgcccagcggatgatcgaggaggtgcaggcatgaatttcgcagatcagaaaatggtcaagaagttgagaaaagagttcccggtcggatgccgaatcgtcctcgatgagatggatgataggcaggcaccgcccatcggaacgcaggggacctgcaacggggtcgatgatgccggaaacatcttagtgagctgggacaccggaagccatctgaacgttgcctacggcgcggacagttgccaccgtgtggcaacggatgccgaggtcaaggtgtcgctcgaccgccttggtaaaacgcgacagaccggcccacgttgccccaggtgcggagcaaagcctgactgttacgaccatcagcagcaggcactcagccgaagggcggacatccagatctgcaaccgctgcggaacggaggaagcattagaggacattgcatggggcggacagcagaagatgcatcttgcagactgggcaatcgtgaaaggagcctgggtcgaatgagggttcttctgatcaaaccgatggagcatccgcaggtggtggacattgaaaactccctgaaagagttctaccgcatcctcgactgcgactgcatcacagccacctacccgtgggaagaacgagccgccctggtcaccgatgacaacgggctgttcaccgagaagtcattcagcagatacattccggagctggagcagcccatcaagggaaacttcttcatctgcggattgggcgaggaagatttcgcagagctgccccaggacctcatccagaaattcagggaacgcttctgggtgccggaggcattcgtcagcatgttcgggcagatggcagtcatccagatggatgacggaacgaagccggaataagataccacaatcagaaaaaataccctctcggccagaaaagaccgggagggcttggttttatcggaaaataggggcctcaaaagaatgagaatccccttccagtttactgtatattacctctggaaagcaacgatagcaaggagaaccgccgccataatgtacacaaacatctggcagcggttttgtgtatcataccaaaccaaaacgggggatacgaggcagaaccccagcttctgctgggggagccttttgggattccttagaagaaatccctcatgctcatgccgacctcgttcagtcgttcttccatgctgtggtagtgccaatcttcttcctcttcttcgtcctcttcctcaagctcttctgggaaggggtcgtgccgccatccggctttctggtattcttcttcccggatgtcgttgcggtcgtaaatgtccagctcgtattcttcttcaagctctgcgatgcggttttcgattgcggtttcaacttctgtaatggtctttttcatggttcttgtcctccgtttttggtttggttttctttgctttcgttgtgtgtataatgccgcagaaacacatatatagcaagtcaatcaggggtcatatatgtaccaaacatgaggggcaaagatcgttgataatatgatgttttatggccttgctatcacagggcagtgacggtaatatacagctacaaaaagcaaaggaggacagcagaatgactgattggagaacatggaaaaaaggaagaaagacaacatggcactggaacgaatttgatggaagcggaagccgggaaggaatcatcaccgaggttcatgaagaccatgcgatcatggaagcagatggcatgcacctttggatcgacgatgacacagcagagatgttcagctaagaaaacggggagggaaacctccctggataaacacataaatccaccagatcagggtgcagataatcgtgtactttagccgcttgatagtgtccggcagtgacggtaatatacagctaccaaaacgaaaggggcaaagaacatggaacgctacacttacgagatcacctttacacggctggatggacagccggatgaaatccagcagcacaccagcgaggagctggcaagagaatgcttccggcttttcgatgagccggacagcgcagagatgtacagcaaaattgaatttagccgccatgactgggagacaggcatggatgagattctggaaacgatgacattttgagaggagaacaaaaacatgacctacacaaaaatcaacctttatcttgcaaatggaattccagaggcactcagcaacctctggtatggaagcgacagtgcggtggtcgagatcagggatgccgttgaggatgcgaagaacggcaaggaccttctgaaccgcatccagaagatgaagctccttcggaaattcacccttgacagggagaacgacaagcgaatccgcttcaagggcacagactgctggggcaacgtaagctaccttgaaatcatccgctaaaggcaagaccgacaggcgcaaggggctggaaatgaccagccttttgctcgtgtctgtcttccgaaagctggcatgaaaagcacataaatatgacaattacaggattgaatgatcgtgtagtttagccgcttgatagtgtttcgaggtgacggtaatatacagtcaccgaaaggggaaaacaacaaaaacggaggatacgacaatgacgaagaacgaagaccgcatcaataaacttttcaaggaactggtaccggatacgggcaaggcagacagcctcgcaggggagctggtaagggcaatgagccgcatcggataccgcttttacaacgacggcgaccagctgggcatcggctacggcaaggaaacctgcaaccctgcagggcggttccttggagccaagggcaacgacaaaatcgcaaagctgactgcagatgcctgggcagtctacagtgaggaagcctacgaaaaggttctggacattctttgcggagcggttgccgactatgttgagcagaacccagaccttagaaaccagccgaccgaagatatgtgggacttcaaggatgaggaagaagaccaggatgacagctgggacgaggaagaagatgactgggatgaagaggaagattacgaggacgaagaagactactaagccagagaaacacatggggcttgccggaaacggcggcccttttcttctgctgtaatacgcacagttccgggtggctatctttgtgtagtatagccgcttgatagtgtgtgacatagacggtaatatgcacataccgaaacggaaaaccaagaaaaacggaggaaaccaccatgaagaagaacatcaccaaggaagaggaaaaagccctgctggagattgccaagcgcctgatggcagcggtagacagacggggcgacctggaagcccgcgacaatgacagcgaggacttcattgaggttccggtctggggcatccagaaagtaatggaggaagcctacctgctgggacggatgaacagataaaccgacagctccagacacagccccacacaggggcttgtgccacgggtggcaaaacaatccgaaggaaccgacaacgccccagacaggggcagatgtggcggcgtggaggaaggggaagcacacatggaagaacggatgatggatgtcatcgtggaaatctacaaccacatggatgacagcgataaggatgccttcacgctggaggatgcagaggatatggtggaagaccagatcaggatggataaggaagccggacgggaaccgctggcatacgacccgcagttcttctacgacaccattgtggaactcatggagcaggacgcagagtgacgtacattctgcctggtatttcgggcagaagatcgtgtactttagccgcttgctatcctttgcacctgacggtaatatgcacataccgaaaggggaaaaagccccaagggaaaaacgaaaacacggaggaattcaccatgaaaaagcatttgatcgactttccagaaaacaacatcagcattgagagtttctacgaccggctcagaccttgctacgacagcatcatgcagttcggtgaccgggttttggttgcccagatgaactggaacggcatgctggagggagcggtatacggatttgtggaagacccagaggaaggctggtcaccgattgagtgccgattggagcttctgaagatttccgatgagacctacacggatgccggtcacgcgatcgagtggtgcatcaagaacgcacactgaaaaagggcagagctccttcgggggcttttgctcgtagtggcggattcttccagtgtggaaatacacataaatccgacaaaaagaggtgtgtatgatcgtgcagcatagccgcttgctatgtccgggcagtgacggtaatatacagtcacaacgaagggaaaagccctacggaaaacaaaacacacggaggatacagaccatgacgaacaaagcaaaaacctaccttaagaacattcaggaagccgacaccgagaagaagctgatcggtatcgagatcgccttcaagcaggacatgaccatcagctgcaacgacctcggaagcctttgcagggcggcagaggacaggcggtacagcctgcggaacaacgaggagacgctgaagctgaagcagatccttttcttccggacgaaagcggagatggatgcctaccacgatatgagccgcaagccggaagactggacggcagaggaaatcgagcagcagagaagccgcttttgcagcatctggcaggtcatcgaggaagcggagttggtcgatgaatacgaggtttggaaggaagccaaccccaacgcataacagcacccaaaaggtacacaccccgaaaaggggctgtgcctcgtatccgatatgttttatataaagttgccgaaatgggaaactatttgttagttatacagaaaagtttcctgtttagggaaatgatatttcgaggacttctttggaggtcctttttctttacccatttttgcagaaaggaggagatgccaatggctaccagaggcagaaaaccaaagccgaccgccatgaaggaactggaaggtaatccgggtaagcatccgctgaacaccagcgaaccgaagcccaataagaaagcaccggcctgtccgaagtggctggagccggaagcaaagaaagagtggcgtagacttgccaaacagatggaagccatcggcatcctgaccgaagtggacatggcggcctttgccggttactgtcaggcgtatgcccgatggaaggaggcagaggagttcatcacccagcacggcactatcgtcaagaccccgtccggctactggcagcaggtgccgcaggtgtccatcgcacagacctatctgaagattatgaatgcttctgcaccagattgtagtttttccttaatttttccggtactggcgatacccacatataactgttttttacttcccgcaaaatatcaaactggcttcccctttcaaaaatataaattttattatatggatgaagcgactctccattctcactcagctcggtgtattctccggtcggaagtttccagtccccatgcaggatttccacaccatctttcagttcttctcttgtctttaactccctctttgcaagatctccatccgcagaagttaagatcacatacggaagctctgccagaagttctgcatccagccctttcagatcaagaagcgactgaaaataaggttcattctcgcacagataccggatgattcccatggaatacccgttctgcaacacattttcaatggcatgcatagaactgttttcctgaaattctgctttgatcgccgtttccttgctctgcattccgataaactctgcaaatgcactggaaatgtaacttgccctcggaacagtaatcttaaatgagagattttctttccccagatcactgcagtcccttttcatttcctctatttcgtaaatgatccttttggcatactccagaaatttctgtccttctcttgtcgccttaactccctttgacgaccgctcaaagatagaaattccaaattcccgctccagatgcttgatcgctttactaagatttggctgcgccacataaagttccttcgccgcctttgagattgatccactcttatcgatttcaactacataatgcaaatctgtcagattcatcttccccatctgcctttctgatctctgactttatctccccataactattttctgaacttttattacagattcttttccagccatttacagacttctgaaaatgttctccctgtttcttttggtcttcctaccgcaacaagaactgcccctgtttcctttgctgcctgtaccttttctccaaagcctccggcttttcccgattctttggtcacaaaatattttgcgcctgtctgatggatcgtagccacgttcatctcctttgaaaatggtccctgcattgcaatgagatgctttccttcaaatccaagcgcgaccgactccataaccgcctgctccgtagagaggactcgcgcaaagcagcgctctttatactccgtaagctttgtatattttatcagttccttgctaccggtggtaatcagaatctttccttctgtattttgcagatattccaccgcatctttaaccgactgcgcccagatcacccgatccgcttcatccggcactgcttccatcttctcccgcaggcaacgcagatactgcacaccggagatttcgcaggctctccttatctccccagtcacaagctgtgcgaatggatgggttgcatcgatcaccagatcgatctgcttttcctttatcatctctgtcatctgcttctgatccatacgcccaaaaaagacttccgcattctcatgctctccggtacattcttttccatattcagttgcggcactgacataaacttttacatttcttccatccagaaattccgtaatccgccttccctctgttgtccctgaaaatattaaaatccgcttcatattctgatccttaccttcttttctgccactgctattgtcacccggttcatgcactgcttcggcatcagaagcctgccatcctctccggctgcaaggatcgccgcccgctcacagacattgtccacacccgtgaccttccggacaaactccgaatgggagctgacacatttaacctttcccaactcttctgctgaaaacgtgtaaaatggaagcttccactttgccgcataagaaagtaatccctcttcttcttttttcagatcaatactgtcgatctcaatgacttccttttctgtaaatccaaggatcttttttgcctcattgaccgcgctttggatttctttttcggaaatccctttgcgacatccgattcccagcaccaggttcttcggcggaagatccagaatcgtctcttcttcccgcctttcgccacttcttcctgcaatccggattccatatggatagtttctgagaaactcttctgtttcacatagctttaattcctccggaaactttccttctactggaaatacactgtaaagtccaatcttattcccatccagaaccacagctgagatctcctttgcctttttccggtctgtcagtaccagaccattgctttttgcaaatacatctactgcaaacttttgttccacatccgttgctgtagtaagtactgcctgcgcatttattttctccgcgatttcctttgcaagctctacagctccgcccacatgtcccgacaggagcggaatcacatagcttcctttttcatccatcaccagaaccggcgaatcggtaaatttgtctttcacatgaggggcgatcatccgcactgcgattcctgccgccccgataaaaaacaaagccttctctccccagaggctgcctatccagcttttcttatcttccggaaaagcatgaaatccgtataatctgcaaaaccgtgtcaaagtatacactttgacacggtatccgctttgtatgaaattctctctgactttacaggccatctgacagcctgcatctgtaaaactcaagattacaatttccataaactttagtatttctccatctgctccacgttcagtacaaaaatcgtacttccgcctacctgcacattgatcggaacggacggtgctgcgctcatgctgctctgtcctgagatcaatgccgggtttgcataagtgatcgtctttctttcgccagaattcttcttgatgatcttcagtgcctctgctaccttctcatcatccactacaaccatgatcgtggtgctctttttcttcagaaatccaccggttgtagccagctttgttaccatgtatccggcaatattcagttcctctatcgtctccagttcatcatccttatgcaggatcgccataatcatcttcatacaaaaaccctcctgtcttatctggcttttgatgccagatccctttttcttttattttaccgcatttacctggaaaggtaaacgaaaatgttgcattttaaaagattagttgaaatccaaaacgaactttaactttgtgcattacctgttacaataatcttcttcaatcctgccatccagtatccggatcacccggtgtgcctgactggcaatctcttcatcatgtgtgatgataataaccgttctgcctgacctgtgcagttctttcaggatttccatgatctcctgtgttgatttcgtatccagattgccggtcggttcatcggcaagaatgatcggcggttttgcggcaaccgctcttgccaccgcaactctctgctgctgtcctccggacatttcattcggcttatgcttcatccggtcttccagaccgacacttttcagggcttccatcgcaagttgctttctctcattttttgacaccccgcggtataccagcggaagctctacgtttccaactgcatccagattactgatcaggttgaatccctggaaaatgaaaccgatctctttattccgcacatctgcaagctgattatctgtcatactcgccacatcctgcccgtccagaacatacttgcctgaagtcggtgtatccagacagccgagcatattcatcagcgttgattttcccgagcccgaatgtcccacaatcgcaaccaagtctcctttttcgatatccagatcgatcccgtcaagtgcacggacttcattctcacccggattgtagattttcttcatattttctatatgaatcaatgcccccataaatgttctccttttcttttcgctctactttacgttcctgttttcaatataccttattttgaatccaatcacaatgctatcctcctggcatcatgaattcttaagaatttctattgaaaacatctttaaatttccttctttataaaaaatatcaattatacatctcgtttaaaaacacttatgataaaactatcatttataaaaaaggagatctgaaaatgaccaatttaaaattaccggaagattttgaaacctatccggaagcaagaaagaatgcttttctgaaaatgaaagagctgaaggagtccgggcgcagaattgtcggagttttctgtacctacaccccatgggaactgattgaagctgcagacgcagctgcagttgtactttgcgggatcggagatgacaatatcccgatcgcagagaccagactgccacagaacctttgtcctctgatcaaggcaagctacggtgccgccctcgctgaccgctgtccattcttctatttttcggacatggtactcgcagagacaacctgcgatggaaaaaagaaaatgtatgaactgatgtccgagcttaagcactgccatattatgcagcttccgccaggaaaaacaggccgcggtgcgctggaattctggaaacaggaggtaatcagcgtcaaagaagatctggaggatttctatcacataaggatcacagatgagcagatccgcaaagcaatccatcttcgcaaccgggaacgcaaggccgtccttgacttctttgagattggacgcttaaaaccgactccgattaccggttatgagatcaacacggttatttcctcgaacgaattcacggttgatctggaagaaaaaatcaaatacctggaacaccgtaccgctgagcttaaagagctttatgaaaaggaatataaaggcaaaccatcccgtccgagagttctcattaccggatgtccgaccaccggcgtgatcgacaaaattgtacgccagattgaagaactcggagcagatgttgtcggctttgagaactgttgcggtccacgtgagaaaaaagatccgattgatgagacaaaggatccaatcactgcaatcgccgaaaaatatcttcgtgtaaactgttcggtcatgagtccgaacccgggacgtctcgaggcgcttgatgcccagattgatgaatatcaggtagatggtgtcgttgaggtccttctgcaggcatgtcatacctttgccaatgagtccgatgcgatccgcacctttgtcaccaaagaaaaaggacttccgtatattgcaatcaatacagactattcttctggtgaccaggcacagatcaatacaagactcggggcatttatcgaaatgctcggttaaaagaaaatccggtgatctttccttcgatcaccggacttcttttttctctttttggcagaatcatttaagcttcttctttcccttcaacaaggctgttcagcttcttgttagccaagaagataagtgctgtaaatactaacataatgactgtgattccaacaaatacagggaacacatcaaatttttcaataaatgcctgtacaaacgggcttaacttgtttgcgccaaatgtagaaattgcgataacccccatcaaaagtgagagatatttcttcggcgcatacttacttacaaatgcattacgcagcggtgagaaacacatctctccgattgtaataaccgttacaaacaggaatggccagaaaacgcttgcttttacagaagcatctacgccaactccgcgaaccagttcacaaacaaccattactccaaacgcaagtcctacaaaaaggaagccaagtgctactttcttaaacatattcatatcgccctgcggacgctcggcaagtttcttccagatggctgccatcacaccaccaagaacgacacacaaaagtccgttccatgtagtagtaacccatgacggcggaatgtcaaaagagccaatactcatcttcacataatcggtcatataaatgacaagcgcaagatcctgctgatagtagaacagccagaagataacagagagtgccgatacaagaatgatcgctatcatacggtttctttccaattttgtaagcggctgcttgtcgttcttcccatcttctttcttttcgttagacccgatcacatttccattctcatccgtaagatacttgaatggtttcacaccctgtccctgaaggtttttccagttcagcacaaaccatgccagaccaacgatgcaccagattgatgccacaaagaagcactgacggaatccaagcacatcgccttttttaaataagtggagatacagaaatccggtaagcagtgaacctacgaaagccccaacatttacataagaatactgaatggaaaatgcagcatccagaagctctttgttctgatattgtcttccgatcagagcgtttaagtttcctttgaaaagaccggttccaatcgatacaagaatgatcatcagattgaccattcccggacctgttgccttccagcctaccagatatccgattgccatgataatatatcccagagagatcgcatatctcgctcccagccatctgtcagagataattcctccgatcagcggtgccatataggtgtacgctgtcagattcgctgccatgactgccgcatctgttcgctcaataccaagaccaccctgtaaagttgcagtgatcaggaatagaagcaagattggctttgctccgtaaaatgccaggcgttcaaacataaatgtgatacaacaggcataaaagccttttggatgtttttcattagtctgtgcttttcccattactttttatttcctttctgttttggcgactgtcgacaatcgtcatcctttataagtaatatagcataacttcaccactttttcaatacagctcatgtcttacactctttttttgttataattcaacaaaacacagcaaaaaaagatgtggaatattactatccacatctcttcattattaatatttatccatttactactatctaaagactgtaacctctctctgtatcctagacaagaaaatcaaatgaaaatccggaatcctcttccgacaatccctgctctttcaaaagccttcggatcgttctcatgtaatgttcggaaagaacgtgacagattttctccttgttcttttccctgcaggcatccaccagttctttatgaatcggatactgtctttctaacacacgctttttatccgtgctcaggctgaagcccgtaacaatatttccataattcagctctttccatgctttatagagccttgtcataccagtcatctctacaagcagtccatgcatctggttatcatagacaaaaacctggtcaaactgctcttcatccagttttttcattttttccagcacttcttccatccggcaaatggtatcctctggaacgtttcctcccatcagcttcactgccatggtttcgtaattcgcccgcataaggtaaatttcaaatgattcttccagtgtaatttcttttacagagcatcctgcatttcttacatattctataagtccttcattttccagctgtctaagtgcctcacgaatcggagccctgcttgtcttaaattcctttgccagatcctgttccacaatcttctgtcccggctccagctcctggtaaatgatcctcttccggataatatctgcaatattttctcttagtgttcgatatattaattctgccattccttttacccaaccttgttactcattctctgccatttcggtgatctgacaccataattattataacaggacagtttctttcctgtctataaaaaaattagaatgcactctgaattttatttttctatcgttcctcgaaatacgccttcttccagattcggaaaaacttgcagagagttcttccggaactctctgcaaatacttctttatgcaatttcaaacaaaccatcgcctgctgccttgatatgacagctgtaaaattctttggatgcctcgatcagataaccggtatcctttacaccggaagtctcataagccgaatgcattgcgagctgcggaagtccgatatccacggtattcatggatacctgcgccattgcaatatttcccagtgtacttccacctgccgcatccgaacggttggcaaaaaactgcaccggtacacctgccttttcacagattgccttgaaaatcgcaatacttactgcatcactggtatatttctgaccggcatgagatttgatcacgattccttcgttcatatagttacagttatttacatctgtcttctgctgataattcgggtgtactgcatgtgcattatcacagctcagcataaaacttccggcaactgcacgatagaaatcttcctcatcctttcccagtgccttgttgatccgccaaagcacatccgacaacagtgtcgatgctgctccctgcttggttcctgatccaacctcttcattgtcaaagcaggcaaaaacattgatattctttgcattttctcctgcaaggaaaccattcagcgacgcaaacgcacactgcagatcatccagctgtggacaggataagaattcattctctcttccccatacagatggctccattcggttatacaggaacagatccataccataaatcttctcttcttctacgccaatctcttctgcgatcagttttttcatctcacccggttcttttgccgatccagcaaaaaccggaagcatgtctacctgtttgttgatcgcacggccttcattgactgcgcggtccatatggattgcaagacttggaatcatcagaagatctctttctaccttgaccagtctggtctccattccactgtccgtctttacaattacgcgccctgctaccgataacggacggtcaaaccaggtagagcagatcattccgccatagccttctgtattcagaaccgtgtattttttcttcacctcaatctctgcattctctttgatcttaaaggtcggtgagtcactgtgggacgcagttacatgaaagctgtactcatccagttggtttccgactttaaatgcaagaatgctggaatggttgcgggtcacataatattttccgcctttttctattttccatttttccgattctttcagctcctgaaatccttcttttgtaagaatatcccggattgattttactgcatgaaaagcagtcggcgagttctttataaatgatgtgagttctttaattgtctggttctccataatgttcctcctggcatttcagcccctttattttccagattcttttgcacgttcacactcggcaagcttcagcatgataattccaagtgcagtcagcactaccggtgtgatcacattcattgcaaaggtaaatggatttttgttatacattcccattatacaacagatcagtgtcacaaaaaacaccatcctccaaaaaagtatgcgatcttctgatttttcacaaaacggtattctgccggaatccggtcaatacatttcctttaattctactaaattcccctttattctgcaaactgtctaatgatgtcttttacaataaggactgctttatccattccttctaccgtgatatgctcaaatacgccatggaatgcatgtccgcccgttccaagattcggacacggaagtcctttgaagctgagtcttgcaccgtctgttcccccacggaccggtgacacgattggtgtaatacctgcatgctcaatcgctgcttttgcgtaatcgatcagctgcatgcacggttcaatcttttcgcgcatgttgtaataagattctacaatttcaacttccacttttccttcgccgtactttttattcatctcttctgcgatatcacgaagtttctgtgctcttgcgtcaaaagatctgcgatcaaaatcacggataaagtatttcatcttagtcgttgtcacatttccctgcacgctgaccagatgatagaatccttcatatccttcggttgtctccggtctttcatttaccggaagcatctggtggatctcggttgcaatggtctgtgaattaaccatcacgtcttttgctgatcccgtatgtacgctgacaccgtgaatggtgataaatgcagtcgatgcattgaaattctcgaactgaatctcgccttcctcatcaccgtccaaagtgtaagcatagtcagcaccaaaaccttccacatcaaaatgtattataccataatcaaaccatttcgtgtacgtttttttcgggatctggcatctgcattcttctttttcaaaaatacggtaggaaatttcccatttcccgtaagatatctttcccgaaacctgcttcagatccagatttttctcttcttctgccaattccgtgtccttctttttccgcttcagttcaattccttcataggttctgcatgcacagaccccataaggaagatccagtctttttccaacctgcttttcaaacagtccctccagcttttctacatgaacctgctccagatctttttcatgttctgccaccaatgccaatgctttccggagaatcattttccggatcagccgttcctgtcggtgatatgcatctgcatggatgcagattttttctccattttggtcagtacagatctgatatgcactttctgtctgccgttccatataatcccagatctccctaagctgatccatagaccgattcatatgctccacggttttttcattgatattttctttaaaatacggaatcacatggttacggatgcggtttcgcatatatgcatcttccatatttgtcgcatcaatgcagtaaggcatctcccgtcctttcagataatcctcgatctcttttctccccacgcaaagaagcggccgtatatacatcccatttaccggatatataccgccgagtccccgaagtccgctgccgcgggccagatgcaggaaaaatgtctctgcattgtcatcctggtgatgtgccagtgcgatccttgttcctccccattcttccgctgcctgctcaaatatttcccttcgtgcagtccttcccgcctcttcttctgacatcctgcattccactgccattttcggaatatccaccgaaacactcctgcatgggatttcttttttctcacacagtgtctttacaaattcttcatcagcttttgcctcttccccacggatcccgtgattcacgtgtaccgcaaggatctcaaatccgatcttttttcgcagctcttccagtatcagaaaaaggcatacagaatctgcccctccggaaagaccaacgacaactttatctcctttttcaagcatcttccactgcctgatatagttctctactttttctaacatggtaaattcctctcgtcttttatctactgtaacacatcttccagattcccgccacaaggactgtcatatcatctcctgcttttccggccgccagctccagcaccttatccagaatataattcgccagttcctccggattctccagcggacttcccccaatcatcagatccagtaaatgctcctgctctcctgccggaagcgcatccaggatcccgtccgataccatgaccaccacatctccggattccaactgtctggtttccttttcactttgctgtctctggattacccccagcggaagactttccgaacggatatgctccaccccgtctttagtccgcagaaatgtcactgccgctcctgcttttacaaactcacattttccattatagagatcaaaaatgctcatatcaaccgtagaaaagcgaacctcttcccgtcccataacaagagccgtattgatcatggaaagtgcagtttccacaggaaatcctgctccaagaagctcttccagcatttctaccagcatcccgctttcctgtagcgctctctcaccagatcccattccgtctgacaaaattgccgcctcttttccacccggaagtgtcttcataagaaaactgtcaccagataccttttgtccgttttttcccatttttgccacaccctgcagcacataatatcccggtccttccacacatacaatagtttcatactcctgtcccagaacctgcctctcgttctgagccgggcacatccttctcttagtacatactgataaaagctctgccgcttttctggttgggatacagtttcccttctcactttttaccgttacatgaatttcatatctgccatgctcatccacaaaaaaaacggaactcagcatccggatccctgcctttttgaaatgctgcgcaaccttttttgcaagcggcggatccgtaaaaatactcgcatccagatctctcgtcacatggcagagcatgtccgcaaaagaatccagctgtgctgcacatccctcacggctctgtaccatcttattattccacaccagaatcctttttgcctcctggaaagtttccagtgattctcgtaaaaaccgtggtgcctgaatacactccctctgaagatgctgtttcatctctttattcagttctgcaccatatccttcaatcgtacataaaagatcataaaaaagctgccagtgttctgccttctttctctccaggcactctgatttcctgctgcatcctctgcacaccttctccgtaatccgatcatacatttctgtcatttcttcgggtgtaaaacattgctttttcggctccattttcagaaacctgtctgccagatgccgaagcgacactgccattttatctgcctgcgttacatatggacttgtgatcacttgctcctctctgtatttaacctccatttgccaccaccctctaaatttctatgaatgaaaaaagcttcgggatattttcttcccaaagcttttcttacgttactgctgtgcgcggaacagaatctcattctcctttacaagtcccagcttctctctggcgacttcctcgatgtattcatctgttcctacatattttttcagtttattaatttcttctgagcgttctttttccgcatcgatctgtgtctgcagttcttcttcctgcaccttatatgcatcattgctctttttgagcgccatcccatgtacaataaccatgccgcataataatataataactgcggtaatcgcaacaatacttcttttgtgcttctgaagcccgctccccggacgctttttccggttcttctttaagcttcccatctaatctattcacctttcgctatcagttgatcttgtatagcttcttactaccaaacccatttagtcttctacagtgtaccgtttttaatcagatttatcaactctttttactcttttttcacaaattcgtgtagaaatctttttgtaagctcttacaaagacagctgaaagcagcgccatcccgattgatccgagcgcaatccccagtccgatataccaccgcagaacaccatcactcgtatgatagatctgcacaaaagtataaacggaaattcctgcccagtaacaggcatcctccagattgatcagccacagtctgtgagcaaccagtctgcgcaaaaccctgatccacagatagactgccacaatcaggacaccggtcaggattgcatagcagaaaaccctgatctcagttccgataccagacattttttctcctcctaccgaaacaattttgacaacagattttctccggcttttgctcccgaatggatatccgaataagaaatattgtcaatattgcctgccaggtcgacctcccctttttcaagattcagccggtttacatgcatgtccgtaccttttaccatcagcattccctgctctgtctcaagcaggatttcatttaaatcaaaagaaagaacgtccagcactcccgttactgtacctgtcttccggttattgataaccagcctgtgattctgaggttttaccagctgtctctcttccatacaaatcccaacctttcctatactgtctttctagttattgtatgaataatatctggtaaatatgcctcggatccgctgccggaacaatctcaaaccacatcttttcagatgttccggaactttaaagataacggaataaatctgccgcctcttcttttttagtcgtatctcgcagatccagaacctctgcctttacagtcttggttccaaactggatctcaatgatatcacctttttttactttcgtggaagccttcgccaccgccccattgatcaggactcttcctgcatcacaggcttcatttgcaacggtacgccgtttgatcaggcgggacacctttaaaaatttatcaagtctcattttgattttcccttcccgtaatatgaataaagcgcagcccttttcagactgcgccatttttcaaaaatgttctacaaattatgcattaacagcatcttttaaagcttttcctgctttgaatttcggagccttgcaagcttcgatcttcatagtttttccagtctgtggatttcttccttctcttgcagctctttcgcttacttcgaaagttccgaatcctactaactgaactttttcaccttttttcatttcttctgtaacaacatcaacaaatgcttttaatgctttttctgcatctttctttgaaatatctgcctgttctgcaactgcagctactaattctgtcttattcatgacttacgtcctcctgtaaaatatactcccggaacaccccggcattttgtctttttgctaggtttattctgcgtatccatgcgttctgacacgccccttaccctacatatgttatataggtttttaccttctttgtcaagtctaaacccttaaaatctaagaaaaccgaacgctatatctgaaacgcaaacagattccgcaaaaaccgctttttttcttctgtctgtgcgacagaaagtgaaagtttttcgacattttttgcaggaatccatgcctttcctgagtggtaatacgaattggtgatcttccagaatttttccggataagcaagacggattgcaaggtaatcccgttcttttttcccaagattattcaccgaatcatacgctctcatcatccgatatccaagccgttcatcataatgatgcttttccatacatttgcgcaggaaataatacagatcttccatctgaacatcccggtgtgcatgttcaaatccagtcaccgccatgccctcctgacagaccagaagattatgataattatagtctccgtggaccatatgattttctgcctccgcttctttaaaaacactgtccagatccatattttccagtattttcagcactctgtctgcccaaaaatacatctggtcatatccctttaaaaatgcgatctcaaacgggcttttcacacttcttctgcagacaaattcccgaacctttctgagttctctgttatgccttgcatactccttgatcaccggattttcttctcttcctgcaaatccgttttcttccccagccagacgcatgcatagatggatccgggcaagattttccgcaccggcgatcagttcattttcacgtctgacatcacactcacgtccctgaaaccatttctttaagatatagcctgttccatcctcggctttactgacataagcatcctctttattaagcagaggcgtatctacccattcaaatccattcgcatttaactgctcatatatttttgcaagcgcgcagatccggctctcctccatgcgcgtctccttcaagaggagcagccccttatctgtatcgcataaaatagcaccccttactttatgggtgccgaatacttccatctgatattgtgtcaatacactgattccataatctttcatggcttccccctgccgctttgttttaccggtctttctaatgtatgcagggggagacttaagtcatgcatgatttttgattattccagttcttttattctggcaagtaaatattcccgtgtatttttctccggttcctcgatcacttcctgtaaaagtgtctggagtgtctgaccaattttcggtcctttttcaatacctgccgcgatcagatcctgaccgtttactttcagttcttttaaagaaacacattgctttttctccagaatctcctggtagcacttctcgataccagccagattttccagcttcttatcacgctgataatcactctgtgccaacgtatcagccatccgtaccttcatataatacgggaacagttccgcactgatccggttcattgcgcggcgtacatgcttcatcgttgcaggcatccggtcatcatgatacagcaccagctttgacaccttacgcagcgtatcattatcgaatttcaagcgatgcatgatcgactttgtgagttcttcgctgacgtatgcatgccctttaaaatgtgccgtcccatccggatcgaccgtctttcgtgccggtttccccgtatcgtgaaacagcattgtaagacgcagcactttatctgccggaatattcatcagcgcatggatcgtatgctcacctacattataacagtgatgcaaagtttcctgcgttgtttccatcattgcatcgaattccgggaggatcacctttgtgatcccaagctcatatgcatcctggatcttttccggatgatcggagaccagaagctttacaagctctgtctggatacgttctgcactgatataggaaagatttggtgcaagttttcggattgcctgtctggtctctttctcaatctcaaatccaagctgtgccgaaaaacggatcgccctcaaaatccgcagggcatcctccgaaaaacgtgcctcagcatttcccacacagcggatcacaccttttttcagatcctccatcccatgaaacagatccaccagtccgtcctgttcattgtacgccatcgcattgatcgtaaaatccctgcgcagcagatcctctgatagacttctggtaaactgcactttactcggatgccggttgtcttcgtatttcccgtcaatccggtatgtcgtcacttcaaatccttctccatttaaaagcaccgtaatcgttccatgctcgattccggtgtcaaaagttctggcaaataatgactttgtctcttccggcgctgccgatgttgtgatatcccagtcacccggcacacgtccgagaaaagaatcccggacgcagccgccgactgcatatgcctcaaagccatgtttttgtaatgtagttataattcgattcaccttttcaggtaactgaattttcatatacattcgctcctagtatgcttttccaaaataaacaacatgtttagcctgtttgccacagaaaatacaggtatctccgtcttttacctgatcctctttgcagatacagcgggtggttgctccacctgttgctgccttgatctcatcttcacattctgcgcttccacaccattttgctttgatgaatccacgtttggtgttgaatttttcattcatttcatccatggtttcagcaaaatcaatatggctgtcaaggaatgcttttgcacggtcatacatatccttctggattgtttcaaggatctcgccaagttttgtctcgatctcatctaaagaaacaacgatcttttctcttgtatcacgacgtacaacaacaacctggttctgttcgatatcctttggtccgatctcgatacgtgtcgggataccaagcatttcctgctcactgaatttccatccagggctcttctcagaatcgtcgatcttcacgctgtagccagcttttttcagtctctctgtcagttcatttgctttttcaagaacgccttctttgtgctgtgcgatcggaatgactcttgtttgaaccggtgcgattctcggtggaagaacaagtccgctgtcatcaccgtgaaccatgatcagggctccgatgatacgtgtagacagtccccatgaagtctcatatacgctgtgaagttcattgttcttatccagatatttgatgtcaaatgcatccgggaacgcatttccgaagaaatggctggttgcagactgaagtgcttttccgtcatgcatcagagcttctacggtgtaagtgtcctgtgcacctgcgaacttctcgctctctgtcttcggacctgatacgaacgggattgcaagggaatcacggatcagttcctgatatacacgaagcatggtcagtgttctctgttctgcttcttcataagttgcatgaatggtgtgtccttcctgccataagaattctctggaacgaaggaacggtctggttgtcttctcccagcgaagtaccgaacaccactgattccatactttcggaaggtcacggtaagactgtacggttcttgcccacaggtcgcagaacagagtctccgatgtcggacggatgcacattggctcctgaagagtctcaagaccaccttttgttacccatgcaacttccggtgcaaatccttcgatatgatcactttccttctggagaaggttctccgggatcagcattggcagatatacgttttcaacacctgtctctttaaatctcttgtcaaggtctgcctggatcttctcccagattgcatatccatttggaagataattaagacatccttttacacttgaataatcacaaagctttgcttctcttacaacgtcggtataccactgtgcgaaatcttcatcacgagaggtaatcgcctgtacaaatttcttttccttagccattgataaagttctccttctcttcatttttgattttataaataaggttatcataaaaccagaagatgctgctctctgcagcctctgccggatgcaggggattcagatcagacatgctttgcccgtaaaataaaaaacaccaaatcttcatgcccctgacaagggaccgaaaattcggcggtaccaccctaattaatcgtattacgattcacttcattacccgttaacgccaggcatacgccacacttttcatgcggaactccaaggtcggttctataatttccatgtagcttcctcccaccagccagaagcctctctgtgccactttcatcatatactagtcctcttcatcgtcaaatctcttcgatttactatagagtttaattgagattttcggatttgtcaacccaattgacaagccctttccgttatgctttaatcaaagaaacaaaattttcgcatatggggaggaattattttgcaaacacctgaaattctatatgaagacgaccagattctggtctgccacaaacctgccggtgttcccgtgcagacaaaaaagatcggcacacaggacatggagagcattctgaaaaattatctgttcatccattcttcacatcatgccggacataagccaccttatcttgccgtgatccacagactggatcaaccggtttccggcatcctggtttttgcccgcacacctgcggccgcgaaaaatctgaaccagcagttacagaacgatcaatttgaaaaatactaccaggctgtagtatgtggatcccttccggactccggcactctgaccgattatctggtaaaggacggtcgcaccaatacctcccgcatctgcagtaaaaatacacccggtgccaaaaaagctgtcctttcgtatgaaatactggaaacttccgaagtgactggcttatccgttgttcagatccatctcggaaccggacgccatcaccagatccgtgtccagatggcaggtgcaggcgcaccactctggggtgacaacaaatataacccggaatttgtaaataaaagaggatatttcccgattgcactgcgggctttccggctttctttctgccatccgaccaccggaaaacgtatggaatttgaagtcccatgtaactgggaacagttggaaacaaaagcagattagcctgcaaataaaaagtcaaggctaaattgaagaacattgaaaattttatacaggttgaaaagtaggtatcaagcagatgggtcaatctctaatttatgcttatctgtctttgtcttcctgtatccaaatgctacaaacggagtcacgcattcccctttttccctcttaatctcaagattactcctgatcttaatagaaatgtcacggcacgtatgttacaaccggcaatcgagaaggatttgaacgttgggcaaaactaaataatctaaaagaagcagcccgcaccttcaactatctttccgaaaataacctgctgaattatgaagatttccaacagcatatttctgacgttgatgcttctgttaaagcggctgaacagagaataatacaaattaacagtgagctgagcacacagaaaatcattcaaaaacactgtgattcttaccgtctctgccgaaaagtgattgaagattgcaaatctgctaaaaatcccaaagcataccggatcaaacatcaggcagaataccagctccacgattcactaaaaaaagagcttcaggatctcggtgttaccaaaatcccaagctctaataaaatccagaagcagattgaaaatcttgaatctgaacagacttctactgttcgggaaaaacaggaattacagaaaaagctgaaaactctggaaatcattcagcagaatttcacagcactgctcaatgctccggagatgcaaattcctgtatcagggaaagatccaactctttaaaaagaagaggtacctatgtaacggtgcctcttccctttccatctaatctgttttattgctctaccctatcacccttaatatgctggtggaagatgtattccatgtggaagattgagctgggtattttatccagctcaatcttccgctccctgtaaatgagaatttgtccgctcctttatataaaataattccatttttcagaactactaactatttttcttcagcccataaaattaaacgatcagaacactctgttggttgcgacactctacatgtattttttataaattctttagtaaagatatgatcaataggtgatgctggagtagtcaatttagtattaatcggggaaatcaatgctcgtatgattctgtataatttctgtgaattagtgacttctcacgctgtggtaaaaacatctaaaaataccaaacacgtctataaaattaatttcgccaccgcagtaaacatatgcagggcatatctcaaacacggcggtgatgaaacagagaccatgcttctcatacaaaagtatctgacacctgtcaggtacaatcgaaaatatcctatccacctcagtccaaagagaaatagggatttcatgtatcgggttgcataaatctcgttaccattatactgcgttatgaggcagatatgcaatctgtctttttgtcatacacaaaaaatgatttgaactcatcatacacctgctttctacgcattagtgcacctaaaaaatacagcatttcttaactgaacagtattttcaatgcatgaacgcatatgatatactgttttcatcataaaaaaccttatctaaatgacattgattatctaattaactacattattttctgtctaaaatatccataaattcgtcacctgtaattgtttccttctcatacaggtacatagccagttcgtccagtttttccctgttttcggaaaggatttttcttgctttttcatgctctgcttttacgagctgcacgactttttcatcaatttccttctgggtatctgtggaacaggaaagagacgtatcgccgccaagatactggttggtcacggtttccattgccaccatgtcgaattcatctgtcatgccgtagcgggtgatcatcgctcttgcaatttttgttgcctgttcgatatcattggaggctcctgtcgtgatctcaccaaatacgatctcctctgccgcacgtccgcctgtaaatgtaacaatcttattctcaagttcttttttcgtcatcagatatttatcaccctgctcaacctgcatagtgtagccgagtgcacctgaggtacgcgggatgatcgtaatcttctggaccggtgctgaatgactctgcaatgcagctaccagagcgtgtcctatctcatgatatgcaacaaccttcttctcctgatctgaaagaaccgcattcttcttctgatatcctgcaataaccacttctatactttcttcgagatcagattcatttacaacggtccttccactacggacagcacgtaatgctgcttcatttataatattggcaagctccgcaccggatgcaccggatgccatacgtgcaatcgtatgcaggtcaacatcatcagatgcttttatcttctttgcatgaacctttaaaattgcttcacgtcctgcaagatccggcagttcaaccggcacacgcctgtcaaaacgtcccggacgtgtaagtgccggatctaacgactccggacggttcgttgcagcaagaatgatgacaccattatttccttcaaatccatccatctctgtaagaagctgatttaaggtctgctccctctcatcatttccgcccatttgtccgtcacgctttttaccaatggcatcaatttcatcaataaacacgatacatggtgccttttcctttgcctgtctgaaaagatctcgaaccttggaagctcccataccgacaaacatctctacgaattctgatccggacattgagaaaaatggtacatttgattcacccgcaactgcttttgcaagcattgttttaccagttcccggaggtcctacaagaaggacaccttttggcatagacgcacctacatcggtatacttcttcggattgtgaagataatcaacgatctctgaaaggttttctttcgcctcatcttctcctgcaacgtctgaaaaacggattccctcactggattgcacataaatcttcgcattgctttttcccattccaaaagccatcgaattttttcctccggcatgctccatcagtttcttcgccatataatttcccagtgcgataaaaaggatcaatggcaaaaccccggtcagcaggaagctgatgatcggtgacatctgcttatcgatatcttttgcgaatactgctccacattcatatagcctgtccgtcaggttcggatcgttcatcagacctgttttataaatatttttttgatctttatctgtaaagatgatctgattgtccttaacttctacttcaccgatattcttcttctcgatcatgctcataaaagttccataatccgtttcctttacctgatgctccataaggattggtgtgacaaccagattaaatacgatcagcactattaacacaatcccataataatatgccagtggttttttcggtgttttaacttctttcatggtctttcctcctgttgttctgcgatatgctttctccgtgcattttcgtattatttattctgccatctgacttcgcccttggacagaagtggataacagatcagctgatctgaatccagattttccgcatgcatgtcaatcgctgtgatctgatgattatcataagtcgtataataataaataccttttgctgtattacaacaggacgtgtatatcgtgatctcatatttgccttctgtcacctcacaacatccacgctgctgatctacagatcctaagatatggaagaactggcttacactctcaccctcttcttcaccggagatcgaatttaattttgtaaaggcaactttcacaaatcttgactggctggaaagatctccaggtattcccattccacccattcctctgctatatgcatcaagctgtaatactcctgcaaaagtactctccggctgttttctggatactccggcataattattcagtgcaaacatctgacccaggaatggtggattattggtaagcactcctaccggattatcatatacatgcagcccatccttcatagactcaacaacgatacaggcgtctttgtctgcaatgatccagtgaagctgtgctgtcggcagctgttcactgaatgctgtgcctgtcagtctcattgctgccagcttctctctcgcctctgctacagtagcacactgtgtaaggatccatgggatgaactcgaactgtgccacctggctgacttctgtttcatcttccggcaaagcctcttcatatgccgcattgccgacaaaattaagacctgccattccaaggcctttttcattaacagcatcataataaagcggataacctcctgcaacaaatgccattccgatcaaagcataatggctttttatcttcccggcaaaccggaaatcaaattcgtaatttcttggcgttatcgtaatctgttccccataggaaaattcataatcaagcgttctacccatataaaaatcttttgttttgtaagttgctgctgtacacatatcgaacacctcttctttctgctataatagtcctgcaaacaatctcataaacaactgtccgatccgtaaatatgcactccgtcctgtgcggtacttttcggtcacttccctgcattcattcattgttgctccaagatcatctcttatatccaaaactgtctgactatccgccataaaacatccattttcaaagtgattataaagcaatgccattcagttaagcatcattttagtggttttctgtcatagaaagccactgtttttatgcctaaaaactttaaaaatattacaaaaaacagttgacaagtaagccaatatatgttgcgcaagccttgattataaacatatttcaaggaggctcattatggctgattttttcttatctaatttaaaatccacactcgacaactgcatcacagaactcgatgaaattcactccatgttctgccgtaatccggaaagtgattttaccaggaaccgcaaactttctttccgcgagtatattcagtttatgctccagatgcagagtaaatccgtttcaaatgcagtaaacatatgcagggcatatctcaaacacggcggtgatgaaacagagaccatgcttctcatacaaaagtatctgacacctgtcaggtacaatcgaaaatatcctatccacctcagtccaaagagaaatagggatttcatgtatcgggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacacctgtcaggtacaatcgaaaatatcctatccacctcagtccaaagagaaatagggatttcatgtatcgggttacataaatctcgttactattatactgcattatgaggcagatatgcaatctgtctttttgtcataaaaaaccttatctaaatgacattgaatgatttattttctatctaaaattttattaaaccgactaaagactccatagtttgtgtgtttgacttactgtttatatctatcttctcctaaatatttttctagtcattgcaatataaaattgcttatacagtctctcccttaagagtcctggtattctggataatatacagagcgaccgatatgaccatcattatagcgcacaaaccaatcaacagatctgataccatcggtgtaatgtggaaccatataatatgcaccgctgcagttccatataataaaaaggttactatctttccatgccagtctgcaccatgtacttttcctgtctttcgtatcacaagacatccactgactaccatatacagctccttacctgccattattacgattaaaagaaacacatacaatacaatggaaaactcaatttaacctcaacaaggtttgttttttcatccatgcaaaatcttctttgtacaacagactgttagatataacaaaaacggcctttcaaaaacagttaacttctaaatcaactgttttttgaaaggtcgtttcatcagattcttatagcaatccagcaaataatctcataaataattgtcccagtcgcaaatatgcacttcgtccggtttgatattggtctgtcacatcacgacattctcccatcgttcttatcagatcattttttatttccacaactgcctgacaatctgccataaaacagccgttttcaaaatggtgatataaacttcgataatccagattaattgttccacaggttgccatacagtcatctgccacactcatttttgcatgacagaaaccaggagtccactcataaacacgaacaccatgtttaactaatccatgataaaaagaacgagttatattataaatgaacttcttatcagggatacccggtgtgataattcttacatctacccctcgcttagcagccaggcataacgcatgtgtcatttcatctgttatgattagatatggagtcataaaccaacagtatttttcagctttatttatcatactgatataaacttcttctcctacctgctcattatccataggactgtctgcataaggttgaacaaacccagtttgctgtgccgcataatcataatggaaaaggtatttactaaaatcagaatcattagcatccttatcacttactgcattccacatctccaaaaatgtcaccgtaagcgactgaacagcatctccttctaaacgaatacctgtatctttccactgtccgtacgggtgtgtgtaattaaaatattcatttgcgagattatatccacctgtaaatccgacttttccatcaataactgttatttttctatgatcacggttgttcaaaaacagatttaaacctggcataaacggattgaatacacggcaatgaattcctattcgctccatttttttcacaaaatctgtattaataaagcctatagaacccatatcatcatagaatactctaacttccacacctgcttttactcgctcttccagaacatcttgaatcttatgccatgcttcagcgtcttctatcgcatgatattccatgaagataaatttctgtgctttcttcaaatccttaagctgtgcctctaatcctgtcactgcttcatcaaaatacacaatatctgtattctgatagattggatactgcgaatttctttgtatgtaacttgcgatatttcctgctttcggaatcgtttcttttattctactcaaacactcctgattgtcaggaagcattggtaataatttactatcaatttctgtatatcgttcacgcattttatgtgtgccaccattcaaaccaatcaacaaatacaggcctacacccataattgggaagattagaattaagatgacccaaggcattttcatagaagaggtcttatctgatgcgtacaatcccaaaaccaagattccactcaaaatccttgtaaataaatttataatttctgcatattcattcaagcgtgttacgatagtaataataaaaattacttccagaagaatgcagactatggaaaaacacagccgttttaccccattttttgtttttgctttgccctctaaagtatcttgcttcatatatattccaccttcctacttgctcagttttctgcctaaatttcatgaaacataccaattttgtcttttattctctgcatttcattatccgcttcaatgatagctcttgcagaatgaagtaattcttcacttatctcatcataaccaggcatttcttcaattccttttttatagcgaagttgatgttccaatgttgcccagaaatccataccattggttcggatctgtaattctacacgcataggtgttttacccttagcaaaaaatactggtatttcaacaatcatatgatagcttcgataaccatttggttttggattttttatataatcttttatttcaataactttaatatcatcctgttgggtaatcaaatctgatatcatataaatatcgtcaataaacgcacaaactattcgaacgcctgctacatcatttaaatatgtctgtatattttctgttgtaaaatcatgtcccattttctgcaatttattgtaaatactattgggcttcttaatccttgtttttataaaagaaataggatttcgattgttctcaactgaaaattcatcatccaaaacctcaagtttagtttgtatctcccgaatagcacaacgatacatcatcattaaattataaaattttgtagcattatttaaaaactgtagtgattccggactgtccatccagagtttttttacttcatcctttgtcatggtactttcctttctacttcatccccgtattcaaaacattatttattttgatagttgattcgttctccttgaattactggataacaaggctatctatataatttagatatttctctttggtcatgactcttttacaatagaaatttctcgatcgtatctatcttctccattccactttaaatgattatttagaacagctactttgcttgttgtatgaaaatatgatgaatgatgctcaaactgggaatattactggtcataatacaattgcatctgctttgaccaatattgttactgggaaggaagatgcaaatttttcatcaccaaatgggaaatataatttctttacttgctcaagtaatacattgaaatgtgatgaatatgcgttcaatgcttcatctattttgatagccggcaatggagagtttaatgttaagcattatacaggaaaatttaatgcttatcaaagaacatatgtgttaataccagacctagagtattatgctcttctgtatttagcaagcatgtatcaaataaagtcatttaaatctgcagcttcaggttcgattgtaaaattcattaccaaaggagatattgaaaatattccagtttttattcctgataataaagctattttaaacaagtttaattgtttgctcatgcttcaagaacaatatcagaaagaaagtgatgaattagcctcaataagagactggttacttccaatgctcatgaatggtcaagctgccatcgaagattgatatgataaataatcatttatcttattattagtccttatcttagcgtcgattttttctaatactgcaaccatttttttctgattcttcaatgaaatcacgggaatagtgtaatttggaaactcctctaccgaaatacgatcaacagtacttcctttatctgccttgtagctggcaataatctccgtcagttttgcaatctgttgcggaaaattccttgcaatgtcatcttccaggcggtactggttattcatgtgattagcttttaaaagctttaattttgccacatccacatctaatgccatcttctcttttactgccggatttccggttgcaagtgctttgacctctgcataggacagcgccgcttcgtccacatcttcacaacttctgaccggtgctttgctcgtcataatctgggaaatgaatttctgcttgttctcgatcaactgccacatataactgtcgaaagtggattctgttacataccggaagatatgaacctttttattatggtttccctgacggataatacgtccttccctctgtaggctaagtacccagcgccttgccatattgctatggtaggtttccaaatactcgcccccgaaccgtacttacaactcacagaggaataaaagaatcgtgctggtgtgagaagaaatttcttatgccagcttttattatgggaggaaatgtaatgggaacagcattggttatggaacatgcaaacgcactggcacagatgatagtcagtgaaaaggacaagttatttgatgaaagagtggaggctcttgtaaaactttatagaagggcggaattttatctgaagcagggatttctggagagcatcgtctgcgagttccatcggaagaaagtggaaatgattatgcaggcggaaacaaaaggagagattacggaaatactgaagttatcaaaaccgcattttgacgggaaaaaatccgtatgctgtggaagaggaagagcttctcctttggtctctgacatcactgcaaggtccactccgggatgaagggtatcgaagatatcgggaattatttgagaagtgcctgccggagatggcagaaaagattccggcgtagaacaatggcataacaaaggaacgaaaaaactatcttttattttactgtaatttcactctttattgaatctgcaatactttacaaagttttttacggaaaaatgcttcggattaatatacttaacaccagtatctatcagcttaaattttgaataaccaaacaccagtgtttcattattcacaaaaatcgtcatctatccagaaagcaggtaaaatatgttcacaataatcagagtattttctgcattcaatacattcttcatctaaagaatctacgccgacataatgaatatgataatctacagtatcgtttacaaatctttcaaggaagatgttcaaaacaaaggctactctatcatcacaataaacataaccaattaaattcttatgaatgatacagtaaacgagataaacacagcgtgtatcaacgatgcagttgaaattgtatccagattaaagcctatttatactttaaagcatgcacggagacagcaagaagacctattcctgtacggaagaggtcttcctgtccttatactaaagttaattggtatgctgaagtcccgcaaaagcaacatttaatttacctccagattaccgcttttaagagatagataatcggaacttccgctaagcagatagaaaaaatattcccctttttcatctggtgagaaactatattttccactcagttcatcgaacacttctccttcatacattatcccgtcttttacataaccgataatcaaatcttgggatactgtaatgtctgatttatatttatcaaacgaaatgactatattatctttatcagttagttcccatccctttccattgtcttgtgtaagtacacaaagtgaattgttgattagaattatttctggaatgatatacatttcatctgatttatcagtaggaatctctactattgatgatggtatgaaattaggcatcagactgcttttaacaattctgctttcaggaaattctgatgaagatttggctaattcctcaatatcaacaactttccccttttcattggtatatacaccgtcttttaatatgatgtagcttctatcattggtttctgtcccgattaaatgtcgattgctgtcatcaattaaagccgatgttaacagatgactgattgcagcatatacaggcatacacaaaaacactgaaaccacagttacaataattgcagttctataagtgaactttaaaggcttatgttttgaagctgttttacaaaatacattttgacgtatcttttgtttggaatattttttcagtattttattgcaatcatgaaaatacacttcctcaataaaagattcatcaatttcactcattaactcattcaaagaaaattttacagtcttcatatctaaatcccttcttttccatttttagttttaattttttacgtccgcgtaacagtttggattttactgtagattcttttaatccggtttcttctgctattacagcgattgtcttagtgtaatagtagtacgagataaaacattttctttcgtcaactgatagttcatatatgctttcttttaagcatttgattacttcttcttttaacggcccgtattcaatatgttcgttcgttccaacctgaaacgcatcttcgtaattttcaaaatgcatcttagaggtttttcgtaatgcgttttttgccatgtttcttgcgattgttcctaaatagggtttgaatgtgctgtagttatctgtatctaaatctgcactgtaattccatagagctacaaaaacattagacacgaccgcctccttgtcttcatatggcaaagcacttccaataatattctcgactatgtatacaacatatctgtagtatttgttcatacatatttttaaagcgcgctcatctttattttttagttcgagcatcagttgtttctcatctatgttaaataacatgcttctacctcataaattcagtgaatactatagcagtggtttaataatgggaatgtgtattttcaaaaaagggaaccgagaaaccaagttaaaaagcttcaattaaaatcaggataagtactcaccagcacttgaaatattttccactattaaaatgtaatagaaaatgatttgattgtaaaggcatcagaggacagattagttaccatgccgtaatagtaatctgttgcctgtgtcgtaaatcctgaacgcaaaccacttgctgtaatctcacgcacaaattctgatgaaggtccagctacgtatgcgcgtactcttgaacgatgaaaagcagaacggctcaaagtgtaatttatagttatgtatctgccgctattacaataaagtcccatactgttatttgatggtgttaatatggcgacttcgccatttttcaatgtgattccgcgccaagtatatcgggcatatgcatttggaataacaccttcttcaacaactttctgcaggctttcgttagcaaacacagtgtacttccattcaatcatattagggtcatctgtaagcggctctgctgcaaaaacattaacacttagcgacagcatcataacgagtgttaggataaaactgattatttttttataagccttcatatatgtacacgactcctttccaaggttccctttgtaataagatacacagtaaatattgtaacggttgcatttatttaaaaaattaaaaaagataatttttaatttttgttttttgaattttttgattggtaaaataagaaaatggattataaagagttgcactctaggtacctcctacgtacagaataagtatcaaatacaaaggagtgaaatcattatgattaaaaaattaagagtagccgtggatcacgggaaccggaacatgaaaacctgtcattttatctttaccacaggactgacggaacaggataaaaagcctgccaggggagagaagtatctgaaatatcagggaaagtattatacccttagtgagaagcggattccgtaccagagggacaagacgcaggacagccggaaccgattctggattctgactttatttgccattgcaatggagctggagcagaaaagccagatccagccggaggatgtcattcaggtggaacttccgattgggcttccgccgaagcattttgcagagctttgtgagagatatgaacgctatttcaaaggggacgggaaggtgcaggaactgtgcttcaacgataaagtctatcacctctgtatacagaatgtaatggcgtttccgcaggattatgcagccatgatgacgaggatgatggaaatccgtgagattccgaaagtcgtagggattgatattggcggatttacttctgattatcttctgatgagaagtggcagaccggatatggattattgtgattctctggaaaaaggtgtgattaccatgtataacgatatcatttccagtattaacagtgaatatgacatgcttctggaggaggcagatatcgacagtatcatcaagggaaaaacgcagtattatgaggaagctgttgtacaggcagtagaaaccatggttcagaattttgttaccgatcttctgaacagcatccgagagcggggcattgatacaaaatctacttatacggtgtttatcggcggcggagcagtgcttctggaacgatttctggagcaggcagaccggttgggaaaacatacctttatccgggatatgaaagcaaatgccgatggatatgatcttttgtatcgcatgacacaggctggagtgtgattttatgggaaagaaaaatccgtttgtattcactattggttttgataagtcggatccagatcacgtgtatgtgacagaacttctgaatacgacagagaaaaaagcaaaactgatcgttgcggcaattctggcatatacgggaagaacggatgagacaggtaatggcagtataagcatggaaccggatatgctccggccaatgatgcagcaaatcatccgggaagaagtaagaaaggtattggaagggcaggacgtttctaagataaatagagaaatgcccacagaagttgatttgatggaagaagaaccgctgcggatggatcagactatgagacagaatgtagtggatgctatcagtgcatttcgcagggcataaaaaagcaggagagatacacatgcttatggcagtgtactctcctgttctttgtatcagaatgggaatagacagaaaactcacagactattcacagattactcacagattgtctttgtataatgtgtagatgatgaaggatacgggagagccttaacttaggttcttgaatccatccagaagtccacgcagtgtagaaagggcaagctgtttctgctcctccgggcaggaatttagttctgccatgatttgctgcatggtagaatccgggttcgttttctggttagaaaatatagcatctatggaaatatgtaagtaagttgccaaggcataaagtgtttccaactgtggattgccaatatagttttcaatatcagagacagtccgtaaagaaatctttgcctgttccgcaaggctgttttgcgaaagattgcggcggagacgttcttccctgactgcatctcccaataattttttcaccatctatatcacctcacttaatgcatatattttatcgtagattaacactatacgaaatgcgttaaagtgcgttatgataagcaggataacacatgcacaaatagagaaacatggaagtaagtacgacagacatgaatggacagcataagataaaagccaaagaggaactgaatctgttaaaaaaatcttatccatacaatgtgtcggagagaagttagaatatgcagtatatgagatactatcatcgcatatcctacacaattacatagaaagagaagtatcggctggactacgaatagagtggtccagcctttctttttttcgaaaaaatgaaggcagtgtcacgttttgttgccgctcaccgccatcctcggaattttttggaacgtgataaaaaatttcggaggataaaacaaatgaacaaaaaaacatatacaggatcaaagatacaaaatcactttacagcatatctgatacagtttgtccgtggaaaacgacatgattatctggagaagaaaatccagatggctgatgcagaagaactgttggaggatattggacagatggaggcaagaattgtaatcgaagaattgctggagaaccaaacgagggagcagcttttattgcaggaggcacaggggaaatatccagaatggaataagatgtcagatgaaagactgatgaaagcgcttcatacgctgcgggatgaagaacggaagctgatttaccagcatgtgtttgaagaacgtacttttgaggaaatgagcaggctaaacgggttatcagaggagcgatgcaagggtatttattattatgcaatccggaagatccgcaaggtgatgggaggtgaaaactaatgaattttgaacgattacttttaaaggcaaaagaaggaaatgcagatgcggtactgaagattttagagatatataagccgcttttaattaagaatgcgattgtgaatggcagatttgatgaagatctgtatcaggaactggtaagtacattgcttcagtgtatccagagattccagataattgagtaagttatcttaaacaaaggctgcaatcactctcaggggagtaacatcctctgggagtgattgttttttgaagggtgatattgcctcagttcgaagcggcagacggtgttgatctattatgttgcctgatgctttaatgctcttttgttgttgccagttctttatgaagatgtagagccataaacacagtaacaatagcagaaattacatcggcaatcggttgtgcatatagtattccatttatgccccagaatgatgggagcaacagaatgatcggaacaaagcaaataccttgtcggcaagccccaagaacgaatccggcggtgccttttccaagtgcaagaaacagagaagaatacactgtgtaaaatccaaatacgaagaaggaaaatccatttgccattagcgatttttgacctacagaaatcatctctgtattgccttctgtaaattgcgaaataatctgtgtggaaaatagggctattgtcaatcccacaactacacaaaatattgttgaccataagatagaagttttaattgcttccctgagccgatcaaactttttggcaccatagctaaagccggcaattggttggaaaccttttaagaagccgaacacaaccagagttcccattgaagtgattcttgtaacagcgcccattccggcgataacagcatctccatagatattagcttcccggtttatgaatgcgatagaaaggcttgtaagaagctggaaagtcaatgtgggtataccgattttcagaatttcagttatgatttgcttagaaggacaaaattccttaatggaaaatgtaaaagcgctttttttctgtaatgcataaattaaatatacaagagtagaagccatttgagaaattgctgtagcgattgccgcaccagcaacccccatgtcgagagtatagatgaaaataggatctaaaccaatattcaatacagctcctaataataatgcacacatagttgtttttgcggcgccttcacttgcaacgatattgttcatcgttacattaaatacattgaaaatacatgaaataacatagattcttccataagaaagggcgtatggcataatcgtgtctgttgcacctaacatggttaaaataggtttcaaaaaaattgcagttccgataataataactgcgccaatacaaacactgctgtataatgcagtactggcgactttacttgcagcttccctatctcctcgccctaaaagtcttgataagtaggaggcggcaccattgccaaacatcagacctaaaccaacaactacttgtcctaaaggaaacgcaatggaaattgcacccatttgactctcgccaagtcctcctatgaaataagcatccaccaaattgtagagagcgttaataagcataccaatcattatcggtataccaagagccattagtgcttggggaacaggtgcatttcctaataaatccattttgttgttattcttgttcatttcaaatactcctttcaattaagaatataaattatagtagtataaattatagtatactacgtgagagaatactactataatttatagtagttgtcaagcgtgtatcctgcaatttccttgacaagaggtataaaatcaaatactataaattacagtatatataaccgtaagtattttatagctttcgtggatatagaaagtgggtgaactatggctacaatagatttaattgtgttaggaatattgaaaaaggaaccgatgggagcctatgatattcaaaaattagtggaatatcgtaatatatcaaaatgggtaaaaatcagtacaccatccatttacaaaaaagcaattcagttggaggaaaaaggcttcattaaaggagaaattgtgaaagaaggtaagatgcctgaaaaagcagtttattcattaacagatgaaggcgaaaaagaatttgtaaagcttatgatggaaacagcctctaaacccattcacttttttttagattttaatgcagtaattgtaaatttggataagttaccgcctgaaagtcaacaatcatgtattgccagtattgaggaaaatattgaaatattaaaaacttatctggaggaaaatcttcgagagaaagagaatgatccggaaatccctaagactggtatggcagtattgcaacagcagatagttttggcggatgctattgaaaaatggattatttctctaaaaaaagacttttgatgaagaagtcactagctgatttcttattaggtctgcaggattgggaagaaacagggatggatgccgacctatgttccggctttgtagccagaacatagaaattttcttagtggggaatctccctcaaacccggtgctccttatatcctgcagattaaacttcaaatttatacccatatccaactactgtttttatgtaattcttgtcgctggaatacttttttatcttcttgcgtatttgaaaaatagtgttttccacggcgtggaaataaccatttgctttttcatgccaaactgcttcataaatctgttgtttagtaaaagccatccctggattagaatatagcatataaagtacatcaaattcttttacagaaaagttaatgtcttttcgtactattaagccgtaggtcgtaaaggtctgcgactttaactttacccggaaaggagctgccacatatataggcagtgctgtaattttaacagtaacggtcaccaatctatggggatggcttgtatatccggctgaaatgctaaaaaatcagtggttcttatttatcacttcactctgccccggtaattatgtgtttgccgtttctggctcttgcagctattgcgattctactggtctattaccagactatttgcaggtaaagcattgctctggttttgaatttgagttttggcagtctaataatagcattttagattagctgtgataaggtgaaacagattaggaggaaagtaaattgcattacaaagacaaaaacctacagatagatattcgctgtcatactgtttttatgaatgatcaaaagattgaattgagtctgaaagaatttacggtactaaaatatctaacagaacatcctggctgggtattctctcacgaggagatttatcgtaatgtctggaaggaagaaccgattgactgtgctaatgcggttatgtgctgcattagccagcttcgtaaaaagttaaaagtagattcacggaactggaattacatccgcaccgtccgaggtgtgggctataagtttcaaccactctcaggggagtaacatcctctggttgcactttaaaatattaaagaaagaatgcgacgagagaggcagcatgaaagggctgcgtgtatttgaaaaataaaggaataaaagagggaccaagggatgattatcagtacgaaatatctgattacaggagatggaaagaccgttcttacggataaggcagtctatattggagaggacggcaagatcgggaaaatcgcaccaaaagaagagctgctgaaagaatttccgcaggaagaagttaaggaatatggtgatgcgacacttcttcctggacttatggatatgcatgcgcatcttgcatacggctattcccagccggacagctttaattttggggcacagctgatcatgttatatgcgttgcagcatgcgcaggctgcatttgaaagagggatcaccacggtgcgggatatgtcttctgcacatggtgtatgcaagaatctgaaactggcagaaaagaagggatttatcgtgatcccgagaatcgtgcatacggataccggaatctgcatgacgggcggacatgcctgggatgaagtcgaggaagcggacggtccgtgggcaatccgtaaagaaatccgtaagcaggttcgcgatggtgcggaatgggtgaagatcctgaccaccaaccgcgaatcgtatccggagcttacccaggaagaactggatgcggcggtggatgaatgccacagaagaggaatcaagtgtggcgtgcatgccggaaccaatccggggatccagatgtgtattgatgccggatttgacacgatcgaacatggaacctttatgacgctggatcatgcaaagcagatggcagaaaaaggtattgcctggacaccgactatcatggcatatacttatctctatgaactgtgcaaggaaaatatcgagaagaatggcgatgcaccggtcagtgatccggtcatgcaaaaagagatggcaaattatgaattctttgaaccggcatacaaagcgtaccgggatcattttaaagaattttatgatacgggtgtgacggttcttgccggcaccgatatggtgatgtatcattctccgctcttaccgcttccgagagaactgcaatatatggtggaatacggaattacaccggtgcaggcagtacaggtggcaacttccaatccggcaaaggttctgggtgtggaaaaagaacgcggacttgttgccgaaggactggatgcagatcttctggtagttggcggtgacttaagcagggatatcaccagattaaaagatgtaaaatttgttacacttggcggaaaaagagtctttgaagacggcatccgttatgtcggaacagggaatatgtttatgtaaaaaaaaggcttctgcgttgcagaggcttttttacacgtaaaaattacttgtcgaaaatttaacaaaataagagaaaacttatcaaaaacagttgcgtattgcatagaaagcaagtataatatacacggcagaaaatttgatttaattattaaatttataaaaatggagggctagatttatgagcaacacaacatcatcaaacccggcgagcttaagaattgccaatttgctcgatgagggaagctttgttgaaatcggtggacaggtaactgcaagagcaacagatttcaacatgcaggagaaaaaagctccgacagatggcgtcatcacaggttacggtgtaatcgatggaaacctggtatatgtatacagccaggacgcatctgtactgaacggaaccatcggtgagatgcacgcaaagaagattgcgaacatttatgatatggcaatgaagatgggcgcaccggtgatcggtctgatcgactgcgcaggacttcgtcttcaggaagcaactgacgcactgaacgcattcggaagcttctattacaaacaggctatggcttctggcgtaattccacagatcacagcagtattcggtaattgcggtggtggactggcagcggcagcagcactttctgattttacattcatggcagagaacggaaaattattcgtaaactctccgaacaccattccgggcaacaccgcggacaaatgcgatacagcaagcgcaaaattccagagtgaagaatccggaatcgttgacggcgtaggaagcgaagaagaaattcttggcgagatccgctcactcgtagcaattcttccggctaacaacgaagacaacgatgcatatgatgaatgcacagatgatctgaacagagtatgtgcagatcttgagaatgcagcagaagatgcagcacttgctctttctatgatctctgacaatggtgtattcattgagacaaagaaagcttatgcaaaagatatggtaacaggattcatccgcctgaacggaatgacagtaggtgctgttgccaaccgctcaaaagtatacgatgaagaaggcaacacagcagaagaattcgacggcacactctcagcaatgggatgcaagaaagcagcagctttcgttaaattctgtgatgcattcggaattccggtactcacacttacaaatgtaaagggactcaaggcaactgcatgctcagaaaagaaccttgcaagagagatggcagctctcacttatgcatttgcagatgcaactgtaccaaaagtcaatgtgatcacaggtaaagcattcggaagcgcatatgtgacaatgaacagcaaagcaatcggagcagacatggtatacgcatggccggaagctgagatcggaatgatggcagcagacatggcagcgaagatcatgtacacagatgcagatgcagatacattaaaagcaaagacagaagaatacaaagcacttcagtcaagcccgctttccgcagctggaagaggatatgtagataccatcatcgaaccggcagataccagaaaatatgtgatcggtgcatttgagatgttatttacaaaaagggaagaaagaccatccaaaaaacacggaacaatttagcgaggtgaagcaaagtgaagaaaaagattagtttagtagtcgcagttctggtacttgtgctcggccttgcaggctgcgggaatgccaagaccgtcagctatgacaaagatacactgatccaatcttgtgatgctgtttttgatatcattgagagcggatccatcacaagcgaccagatcacagagatgtcagactggaatcagggatatctgatggcacagtttgaaagccagaccggtgtgcagatggaagcagacacttttgcaactgcactggaaggatggaaagcatccctggaagaatgcggcgattatgaaagccataaagactatgaattcgaggcatcttctacaggtgttacggtaactgcaccggcaacattttctgacagaagtgcagacctggaattcgtattcgatgagaatatgactctggaatcatttacagtcaatgctcattacggcatgagcgaaatccttgaaaaagcgggacttaacacattacttggtatgggaactgtattcgtaatgcttattttcatgagctttatcatttccctgatcaaatacgttcctgcattacttaacggtacatccaagaagaaaaaagaagaagctccgaaggcagcaccggctccggcagtggcagcagctgtagaagaagcagaagaaatggatgataccgaacttgttgcagttatcgcagcagcgatcgcagcagcagaaggaactactacagacggatttgtagtacgttctatcaagagaagaaaatcaaacaaatggaatgcatagtgcgaatagaatcaggaggatttaaagatgaaaaactatacaatcacagttaacggcaacgtatatgatgttacagtagaagaaaacggaaacggagcagctgcagcaccagtagcagcaccaaaggcagctccgaaagcagcaccgaaggcagctccaaaagcagcagccggagctggaagcatcaaggtagaagcaggtgcagccggaaaagtatttaagatcgaagcaagcgtaggacagaaagtatcccgcggtgatgcagttcttatcgtagaagcaatgaagatggaaattcctgttgtagctccggaagacggaacagttgcaagtatcgatgtagcagtaggtgatgcagtagaagcaggacagacactggctacattgaactaaggagcaacatccttttgaaaaacaggaggttataacatggaatatatcactaacacactgggaaacctcgtgcagcagactgcgttcctcaacctgacttggggtaactacattatgatcgcagttgcatgttttttcctttatcttgcaatcaagcatgggtttgaaccgcttctgcttgtaccgattgcatttggtatgctcctggtaaatatttacccggatatcatgcttcatgcagaagattcggctaacggaacgggcggacttttgtattacttcttccagctggatgagtggtctattctcccgtcacttattttcatgggtgtcggtgcgatgactgacttcggaccgctcattgccaacccggcgagcttcctcctcggtgcggcagcacagtttggtattttcgcagcttatcttggcgcgatggctcttggtttctctgataaggcagcagctgctatctccatcatcggtggagcagacggaccgacatccatcttccttgcaggtaagctccagcagacggctctgatgggaccgatcgccgtggcggcgtactcgtacatgtcactggttccgatcatccagccgccaatcatgaaacttctcacaacagagaaggaaagaaagattaaaatgggacagcttcgtccggttacacagcttgagaaaattctgttcccgatcatcgtaaccatcgttgtatgtatgattcttccgacaacagctcctctggtaggtatgctgatgcttggtaacctgttcaaagaatccggtgttgtaagacagctgacagagaccgcatccaacgcaatgatgtacatcgtagttatcctgcttggtacatctgtaggtgctactacaagtgcagaggcattcttaaatgtcagcacattgaagatcgtactacttggtctgatcgcattcgcattcggtaccgcagcaggtgtcctgtttggaaaactgatgtgcgtagccacacatggcaaggtaaatccgctgattggttcagccggagtatctgccgtacctatggcagcccgtgtatctcagaaagtaggagcggaagcagatccgaccaacttccttctgatgcatgcaatgggaccgaacgtagccggagttatcggaacagccgtagcagccggaacatttatggctattttcggagtaatgtagcaacaggaagcgatttgcttgcttgcaagggcaaatcgcggttgctgttgaaatgtcagactgtgccatcaggcacagaaggaaaccgtcaggtttccttagcgctgcgagcagcgcgtatctgacagtgagataacaatcctggagcttaataaaccttataataattggaggaagatataatggcagcaattgaaaagaaaccgattaagattacggaaacagttctgcgtgatgcgcatcagtccctgatcgcaacaagacttaccacagaacagatgcttccgatcgtagataaaatggacaaagtcggataccattccgtagagtgctggggcggagctacatttgatgcatcccttcgtttcctgcatgaagatccatggtcaagacttcgtaaattccgtgacggattcaagaataccaaacttcagatgctcttccgtggacagaacatccttggataccgtccatacgcagatgatgtagtagaatacttcgttaaaaaatctgttgcaaacggaatcgatatcattcgtatttttgactgtctgaatgaccttagaaaccttcagacagcagtaaaagcagctaacgctgagaaagcagaagcacagatcgcgctttcttacacacttggagatgcttataccttggattactgggtagacatcgcaaagagaatcgaagatatgggtgcaaactctatctgtatcaaagatatggcaggtcttcttcttccgtacaaggcaacagaacttgtcggagcattaaaagaagctgttgatatcccgatccagctgcatacacattacacatcaggtgttgcttcaatgacatacttaaaagcagttgaagccggtgtagacgtgatcgataccgctatttcaccgttcgcacttggaacttctcagccggcaacagaagttatggttgagacattcaagggaacaccttatgatacaggatttgaccagaatcttctggctgagatcgctgattacttccgtccgatccgtgacgaagcacttgacagcggacttctcaatccgaagaaccttggtgttaatatcaagactcttttgtaccaggtaccgggtggaatgctttccaaccttacttcccagctcaaagagcagggagcagaagacaagttctacgacgtacttgaagaagtaccgagagttcgtaaagatcttggtgaaccaccgctggttactccgtcatcacagatcgttggtacacaggcagtattcaatgtcctgatgggcgaacgctacaagatggcaacaaaagagacgaaagacatcctgagcggaaaatacggtgcaactgttaaaccgttcaacccggatgttgttaagaaagtactcggagacaatccggaagttatcacatgccgtccggcagatctgatcccggatgaactcggaactcttgaaaaagagatggaacagtacaaagagcaggatgaagacgtactcagctacgcactcttcccgcaggtagctacagacttcttcaaataccgcgaggcacaggagaagaaagtagatgctacaattgcaaaagacggaagttatccggtataataacgacgaactgacgaaagctgttacagacagtattttgtgagcaaaacgtaacctcaggagccataaaattcgagttgaattttatggctcttttgcttataataaaaagggttgtgaccttatttataatagaagaaaatgattttataaaaaggcacgtttcttatttggaggcaaattgtgagcacaaaaaatgagttactgattagaattgatgagagatatccgaagttcagcaaaggacagaagcggcttgcggattacatcaaagaaaattatgataaagcagccttcctgacggctgcaaagatgggagaggcagtcggtgtcagcgaatcaacggttgtccgtttcgcaacacagcttggatataaaggctatcccgaattccagaaagcactgggagaactggtgcgtaccaagctgaattctatccagcgtatggaagtgacctacggacggatcgaccggagcgagatcctggcgacggttctgcagtctgatatcgagaagatcaagcagacattggaatccgtggacaatcatgcatttgagctggcggtggatacgatccttgcggcaaaaaaggtttatgtgatcggaatccgaagctgtgcaccgctggcaaaattcctgactttctatctgaatctgatctgtgaggatgtggtagaggtcgataccaacagttccagcgagatttttgagcagctgatccggatcggggaagaagatgtgatcatcgggatcagttttccgcgatattccatgcgtactttaaaagcactggaatttgccagcaaccggaaagcaaaggtaataaccttgaccgacagtgtgaattcaccgatgaatctctattcctcctgcaatctgatcgccaagagtgatatggcatctatcgtagattctctggttgcaccgctcagtgtgatcaatgcactggtggttgcactctgcatgaagaagcaggatgatgtcatcgagacgctggagacactggaggacatctgggacgaatatcaggtttattccagagatgagctggagcctgtagaagatgaggtaaggatcaaatgagtaaagtactgatcgtagggggcggagctgccggtatgttcgcatcgatctttgcggcgaaaaatggcaatgaagtccacgtatttgagaaaaatgaaaaacttggaaagaagcttttcatcacgggaaaaggcagatgcaatgtcaccaatgcctgtgacgtggatgaacttttccaaaatatggtatccaatgagaaatttatgtacagcagtttttacggatttaccaaccaggatgtgatggatttctttgaaaatgcaggattgcgtctgaagacagagcgtggcaaccgtgtatttccgcagtcggatcattcttcggatgttatccgcacactggaggtggaaatgaagcgaaatggagtacacatccatctttattccaatgtagaaaaggttgtggcagaggatggaagattttcctatcttgtcatggcagatgggagcaaagaagaaggggatgcttgcattatcgcaaccggtggtatcagctatcagacaacaggttccactggagatggctatcgctttgcagaagcgatgggacacaagatcaccgaacctgcaccttccctggttccgatgaatgtcagagaagagtacattccggcactgatggggctttccctccggaatgtccaggcaacggtctatgacggaaagaaagagctgtacagtgatttcggagaaatgttattcacccactttggagtaagcggaccactgatcatcagtgcgagtgcctatgtaggtaaaatcctgcagaaaaagcatgagttaaaactggtcatcgacctgaaaccggcactttccgaagagcagctggatgcgagagtgctgcgggaatttgatgcgaaccataataaacagtttaaaaatgcagttaccggactgtttccggcaaaattacttccggtcatgatccacttaagcggcattgatccggaaaagaaggtcaatgtgatcacgaaagaagagcggatgaatttcgtccatctgatcaagcattttactgtgacattgaccgggcttcgagatttcaaagaggcaattattacacggggcggcgtaaaagttaaagaagtcaatccgtctacgatggagtcaaagctggtacagggactgtattttgcaggggaagtgatggatctggatgcactgaccggtggattcaatctgcagatcgcatggtcgactgcatatgcagcaggaagtaatatctggtagtttttggattatagatatcgcacagcaatccagagatggcgtaaacaggaaaatgtgagtgaaacagtccagcggtgtgatgtcaagagataaataacacaaaaagcatatatttttgtatatatctcatgaagacaaaaaaatatatgtcttatgaactgcgtgaccgccaggtggacggagaaaagctgttctataagggagcgaccattccggatgaagtaaaggaatacgaagaaccggtagatctggatacgcttcttgacgggctgaccctgacgaagctgaatgatatttttcaggatatcctgaaaagacaggcagataagacggatccgatccgaagtaagttcggcaagatcgagaaagaagaggttacgcttccggagaaactggaatatgtttatgagtatgcaaaggtacatcacagattcagtttccgggatctcctgaaaaagcaggcatccaaggtacagatcattgtcaccttcctggcggtgctggagctgatgaagacaggagagatacaggtatatcaggaacatacgtttgatgatatcatcattacatcggacgagggactgcggcaaggagtatagaagaaaatgagaacaaaacagttggagagtatcatagaggcaatcctgttcactatgggagattcggtcgaggtgagtaagatcgcatccgcgatcgagcaggatgtgccgacgacggagaaacttatccataatatgatggacaagtatcagaaagaggagcgtggcatccgaatcatcgaactggatcatgcatatcagctctgtagcaaaccggagatgtatgagtatctgatccggatcgcaaagcagccgaaaaagtatgtcctgacagatgtcatgctggagacgctttcaatcattgcttaccgtcagccgatcaccaagctggagattgagaagattcgcggagtcaaatcggatcatgcggtaaacaagctgatcgagtacaatctggtctgcgagcttgggcgccttgatgcaccgggacgtccgctgctttttggaacaaccgaagaatttctgcgcagattcagtgtgcagtctttagatgatctcccgggcattgaaccggagaagctggagacattcaaagaagaagcggaagatgaggcacagatccggctgaatatttaaaatggaatccatagtataaacgcccgtccctgttcataaaatggaacagaaaagagcaggagggagaccggggcgcatgaaaaagaaagaaaagaagaggaatggaataccggcacggaccagaagagggattctggcagcgtgcatggtattcttttttagtttgcagatttttcaaggaaagatgctatggagagaatccacaggagaaaatccgggtaaggtcttatctggaaaagtgcctgcggaagaaaatgaacggacacagataatggagactacgcagcaaaaggaaccggtctcggatgcgcagactgcacaggaaaaagaaatccgtgagcaggaaagggaacagcttcttacccggctctatgcccgttccgctgcgctggtggatgcggacagcggcagggttctgctcggaaaagaagagcatgtaatgcgcccgatggcaagtacaacgaagatcatgacctgcattcttgcactggaaaagggaaatccgaaggacctggtgacagcctctgcaaatgcggtcgcacagccgaaggttcatctgggaatgcacgaaggggaggcgttttatctgggggatcttctatattccctgatgctggaatcccataatgattctgcagtggcgatcgcggaacaccttgcaggatctgttccgcaatttgccgggtggatgaatgaaaaggcagaagagatcggatgcactgaggcacattttgttacgccaaacggattggatggagaggatgtgggcggtgtgcacagcatttcagctgcagatctggcaaaaatcatgagctactgtgtcctgcgttctcccaaagctgcagaatttcttgcgatcacgcaaatgccggtatacagcttttctgatgctgagggaaaggggaattttagctgcagcaaccacaatgcatttcttcagatgatggatggcgcgatttccgggaaaacagggtttaccggggatgccggatattgctatgtaggggctttacagagtgagggtcgtacatttgtagtggcactgcttgcctgtggctggccaaacaacaagaattataaatggacagataccagaaaactgatggagtacggaatggcacattatcgttatgatgaggtgtggaaaataccggagctttcgaaaatacccgtggaaaacggtgtttcccaaaatggtttgtttggaaaagcagcagtggaagtggaaatcaaaggaaaagaaagtccgggtaagattctggtcggagatgatgatgtggcagaagaaaagacagaagtgccggaaaaactggatgcgccggtgaaaagcggaacaccggtcggacagattacgtatctcttaaacggggagaaatgggggagctgccaggctgttgtaaaagaaacagtcagacggagaacatttacctggatagccatgaaaatgtgtgaaatgttttaccaatttaatttttaaaacacgagaagaataaaatagatcaagaaaattgcttaaattcatcaatggactttcgcgataagatatgttagcattagctagacaacaaaataagacaagaaagttgacggatatttgtgaaaagtcaggaattaggcaaattgtgtgatttttatgaaaaatttcttgttttttcatatgaacagaagaaaaagcagatgccgccctttccaattaaataaaaggagagaaacaaaatggaaaattgtaaaaaatacgagagacaatattttatgcctccgaaatttgaatatgattgggtgaaaaaagattatgtagacgcaccgccaatctggtgcagcgttgacctgcgtgatggaaaccaggcactgatcgagccgatgagtctggatgaaaagctggaattcttccagttattggttgatgtgggattcaaagagatcgaagtcggattcccggcagcatctgagacagagtaccagttcatgcgtaccctgatcgagaaagacatgatcccggatgacgtgactgtccaggtactgacacaggcaagagagcacatcatcaaacgtaccttcgaagccgtacagggagcaccacatgctgtgatccacgtgtacaactcaacctctgttgcacagagagaacaggttttcaaaaaagacaaagaacaggtaaaacaaatcgccatcgacggagcaaagctgttgaaacagcttgctgatcagacagaaggaaactttactttcgagtacagtccggaaagcttttcaggaacagaggtggactatgcagtggatgtctgcaatgcagtactggatgtatggcagccgacaaaagataaaaaagtaatcatcaacattccgacaaccgtagaaaacgcaatgccgcatgtatttgcaggacaggtagaatatgtagataagaatctgaaataccgtgatggcgtggtactcagccttcacccacacaacgaccgtggatgcggcgtggcaactgctgaaatgggtattcttgcaggtgcagaccgtatcgaaggaaccttatttggaaatggagaacgtaccggtaacgtggatatcgtgacactggcactcaatatgttctcgcagggtgtagatccgggactggatttcactgatattccaaagatccgtgaaatctacgaacgcctgaccagaatgcatgtctatgaaagacagccatatgcaggagatctggtatttaccgcattttccggttcccatcaggatgccatcgcaaaaggtatggcatggcgtgaagcggaagaaagagatcactggaccgtaccgtatctgccgatcgatccgaaggacatcggaagaacttacgataaagatgttatccgcatcaacagccagtcaggaaaaggcggtgtaagctacattctgaaacagaactttggcatcagcgttccgaaagaaatgcgtgaagaagtcggctacatggtaaaagatgtatccgataaagcacacaaggagctgactccggactgggtataccacatttttgaagatcattatgtaaattacaaaggaatcttctctatcgatgaatgccatttcaaacaggaagatggtattatagcagatgcaaccatttcccatgcaaatggaaaacgtgtggtaacagcaggcggtaacggacgtctcgacgcagtcagcaatgcgatcaaacagtactttggtatcagctatgaactgagcttctacgaggaacattccctgacacgtggttcttcttccaaggcatgtgcttatgtaggtgtcatctgcaatggaaagacctactggggagtcggaattgatgccgatatcatcaaagcttctattgaggcattgacagttgctgtcaataagatcgatgaactgaagaatgtgaatgaatgtaaagatgaaagaatggtagagatcatgaactatatccaggcaaattatctggatgtatctttagatgatctggcagaaaaattcttcctgtccaaaccgtatctttctaaatatatcaaagaaaaatccggaatgactttcggggatattgtcaaaaaagtcagaatgaaaaaggcacgtgccctgttaaagagcagcagcatgaccgttgaaaatattgcattgaccgttggatatcagaatgtagagcatttcaacagacttttcaagaaggcgtacaatatcacaccggtacagttccgcaaccagaaataaataatacataaaaatgacgaaaaaagggcgcaaaaaacgggaaaaagacgttttttgcgttcttttttgtcgatgtttatgaatgtgaacaaaatttcatatttacagacgaaaatattgacaaagttaacaaaaaaaagtaagatacttgtatgttcaaaataaaaaacaaaagttaaaaattatgaaacaaggaggagtgaagacatctgaggatggggaaaaattaacgattgttttttgttgaatgaatacaaaaggttatcttggagggaaaataatgaacgaacatgatgaggcgttaagaaaacaaaccgcctttttaggacagccaaagggtgtgggaaccctgagctttatgcagctttgtaactcttttgcaaactatgcgatgagtgcggtactgatttagtacttatacgcaaatgcaccggaaggacttggattcagcaaggcaaatgcagcacagctgatctctttatattcaacagttgtcgtactgacaggtattgtcggaagctttgtctgcgaccgtatcttaggatgccggaagtctttatttatagcaagatcactttcatttattggatatgtatgccttgcattaccacttggcgttcctggctatggaatcgctatgggatgtctggcaatcggaccgatgttcggtggcagatgtctggatgctcttcttggaaaattctatgatgaatccgatggaagacgtgacagtgcttacacgatttcttacgtaatttccaacattggtgcagcagctccggtactttccggtgcaatcgcagcagcactcggataccatgtagcattcgcggcatgtgcagtccttgcattcctgggtatcgttgtatatgcagttacatacaaaccgttcttcggtaatatcggtattgaaccggatgatccgcttccggatgataagaaacgttctttcatcacaaagatgatcattgtacttgttatctgcgcagttgttcttgcaacgcttttcgcaacaggaacattaagtatttctgtattctcaaatgtaatcagtactgtatcgatcattatcccgatcgtatacctggtagttatttacaaaagtaaaaagacagagccacatgagaagaagaaaatcctctgcctggttccgccgttcatctgtaacgcagttaccctgctgatctggacacagacaatttcaatccttgcaatcttctatgaagaaaaggttaaccgtgtactgttcggaattgaagtgccggcagcatctatgcagacaatcccagcagtatttgcagttatcatcggaagtatcctgacagcagtatggacaaaacttggaaagaaacagccatgcggaaccacaaagatgggtatcggaacaatcttctggggatttggagctttaatcattgcactcctctatgtaatctatcctggagatgcaaaagtcagcgcatggtggatcgtattattctatgcaatcctgatgcttggtgaaggatttacctgcccgatcggttactcaatcacggctgttgcagcaccgaaggcattcatgacacagatgatgacaatctggtcaatgtcacagtctacaggagctgctcttaacacactgcttactaatttctataaagaaggaagcgaaattccgttcttcgtagcaatcggtgtaggtgtatgtgcagtcggtgcggttgtagcaatcttcagtaaaaagcttgcagtcggaatgggactggacaagaacgcagaagcataaaagattaggaaataagtttatgtttcaggaggatgaaaaataaatgtcagagaattgtaattatgcaccggtcgaaaaagtcattctgatcgatgacagaagaattgagatttattggggcgaacagatgcgccgtgctgataatgaaaacgattatctggtaaaatacaaaggggaagtacaggaactggtacactggaccagtgatatgacatgggattatggtacggtataccagaaagaatccatgcgtaccacactttccctggttcatccggttgatccggaatgtgcaggagaggttaccgtacaggttgtcggaaagctgactgatgtaaaagacagaccggcagacaatgaaaaggtctaccagaccgtgtatcagccatattatgtagtccgcaaaaaaggaacctccggcattgtagtaaaagccggagaaaaaacaacaccggctgtagtggataaagcacttgcaattattgatatgatgcttgaaaagatcccggaagtagcagaagagctcgtccgcagaggcgcagaggtatctgtgttcggactgcttgagaatgcatatgatgtcccggaacacagaatgggatatctgcttgcaacccgccacgtggcaggttacggcggtgagatgacgaatccggcatcctctatttcagaggcaaatgtaatccgtctcagaaccggaagatatgcaaccagttatccaaatgagatgatccttgtgcatgaattcggacatgcgatccatctggttggaatgaatggtctgaaagaccagacgcttgcagacatgatccggaaagcatatcagcatgccagcgacaatggtttgtggccggacacttatgcgatcagcaattacgaagagtattttgcaaccttaagtactgtctggttcaatgtcatgcaggaaggtgttgacggacgatgggatggtatccgcggaccggtcaacacaagagaggaactgaaggtttatgatccggaaggatatgagctgatgaagcacatttatccggagaagacacttccggaaccttggcattataatgtaaacatctatgatattgatggaaaaccatacaaatcatatgatgaaaatatgaaattcaactgggatttcattcagtaggagatggaacaatgaatacacgcatacagaaaattgtagatgctgtaaagaaaaatggtcatgatggaattgtgatcagcaaaggcagcgacattaagtatctgaccggctttaccggagaatatggagttgcagtcctgcttttgacagaaaagaaaaactattttgtaaccgacggacggtttgaattccaggccgcacaggaaacagaaggatttgaagttgttgtctacggtgaaggactgaattacttcagccagaccggtaaattggcggcagaagcaggggtaaaacagtgtgcaatctgtggagcagatcttacgtttgatgattatcaggatctggtaagtcaggcgcctgataccaaattcgtttccgaagggtcttatgtagaacctttacgtgcgatcaagacaccggaagaaatcgagacgatcgaacaggcatgccggatttcagagagatctttctatgcactgcttgatgtgatcaaaccgggcgttacagagatcgatattgcaaatgaactggaatatcagttcagaagccgtggcggctccggattctgcttcgagacgatcgtagcatctggtccggataacggagcaaactgtcatgcgacagcatccgatagaaaaatccagcttggtgattttgtgacgattgatttcgggacttattatcacggatactgctcggatattacccgtactgttgcagtagggaaagccaaagatccggagctttacaagatgtttgacgtagtcagaaaagcaaaggatgctggtcagaacagcctgaaaccgggaatggttatgggcgagctcagagatatcatcgtgaaggtagtagaagatgcaggctatcatattccacatggtccgggacataacttcggactggatattcatgaacagccgtatatctgtaccggcagtaaagtgatccttcagccgggaatggttcatacgatcgaacctggaatttacattccgggaatcggcggcgtccgtcaggaagatgatttcctgatcacagaagatggataccgcagaattacaaatattacagatgctctgattacactgtaataaaaatgttgtcatcctaaaaaagtataaagaattgaggaaatccttatctggtggtttgccggataagggtttccttttttgtggggacggtctgcgaaagggaggtagtgaggcagattaaaaaatataggggtgaagtccattgtgcaaaacattccgatgagcctctgaaagcgaaaattgtgtcagcagaggcttccacaatttttgagtctcatctccattgcacaataagtgccttcacccctatatttttttaaatctgtcgctgtaatctttggacgcagacctgggaatcacaaaattttaatattgattgttaaacgatgttgtgagtaaaatgaaaagtgcaagtgtatccgtataaagttttggacgtaaaacggattaaaaaatgcaaaatatttaacagattctgtggaaaacggttgcgtcggtttgaaaaaacaagtataatacacttcaaaatggttgcactttaaaatattaaagaaagaatgcgacgagagaggcagcatgaaagggctgcgtgtatttgaaaaataaagttgatacctacttttcaacctgtataaaattttcaatgttcttcaatttagccttgactttttatttgcaggctaattcttctagaatatccggataatccttcttgcacatttcgtaaatatcagcatggctactttcatatcttcctgctgcttttgtaaattctttaattgacaattttttatattcttcatttttcatgctttttttctccaatcactgtaccttttcgccttgcatccgcttttcttcattcttttcatataagcataaaactgcttatgcaattctctcatttcatctggtgccttcatagcatgttgatacataaatttatctccaaagctgcttccaaatgtaactgccagcataattgttaaaaatgacaatggcaaaaaacgaaaaatattcattttccatggtgacaatttgcccttttcttttcgtaaaaagttaaaatttcttttcagcctttctgctgtttttctcataatattccattctttttctactttctccggacagtctgattcgtaatacgcatccgcaatcggtaccaccatagcaagatgacaaagctgccatagatgcatatccgttactttctggtatggtatatgagcatgcctcaatatctctgaaaactgcttagttctttcggatttatttcctgatatttctgcaaatgttgtcggctgaataaaccttggagtgagtgctgcatcaaggataccatcatcagttatacttccgcctgctcctggaaaagccggtaatattcttcctcttccaacaatgtcttcccattttttataactatccagcgaatttatcattgtaacaatcgtagtacttttattatttttcaattcagcaagtgcttcatacagctggttttctcggacagtcagcaagataaaatcataaatatcatcatttggctgttctccaagaatcttaacttctgcctttatcactttctgatttttcttataaagcaatccattatttcttagaacctcaagtcttttacctctggcataaatacttgtatcataaccggcttctgcgaataaagccgcatacaaggatccaatcacaccagcaccataaatcaatattctcataagaatcattcctctccccttatcccagtgccacatccaagatcatcattaaactaaatccaagcgcaaagaaaagcgtaccgatattcgagtgctgtccctgcgacatttccggaattagttcttcaaccacaacatataacatagctcctgctgcaaagctcagtaaatatggtaatgccgggattaccagctgtgcagcaagaatcgtcagtactgctccaatcggttcaacaactcctgaaagtacacctccaagaaatgcctttcccttactttcgccctctgccctaagtggcatggatatgatagctccttctggaaaattctgaatggcaattccaagtgataaagcgagtgcacttgttgcagtaatctgtgcattttcagcaagaaatcctgcatacattacaccgactgccataccttctgggatgttatgtagtgtaactgccaacaccatcatcgtagtacggccaagtttgcttttcggtccctctgcctgatcacttccaacatgaagatgtggaatcaaatgatcaagtgcgagtaaaaacaatataccaatccagaacccaacaactgccggaacaaaagataaagttcccatattctcagattgtttaattgccggaatcagaagactccaaattgaagcagcaaccattatacctgccgcaaaccctgcaagtgcacgttgcactgacttgctaagagtttttctcataaaaaacacgcatgccgcacctagcgttgttccaacaaatggaatcagtataccttcaaaaacattcattagcattatgttttcctttctgtataatcaaaaaatctttcatatcgctccactgttagttttcactaacctttgtatataaaggaaaccgtgcaaaaagcaaactataatttcacacggttttccttgtgtttaagtatatcacttacgaaatcatataacaatataattcttttcaatcttcagaaacttttgaggatcagaatgattatttattgggataaaaaacgaacagtaaaaagcagaataggacaacgggtaaaagaattacgaaaggctcataatcttacttagaaaacactcgctgccaaattacaatttccaggatatgattttaatgatctggcaatcctgcgaattggtcaaggcacacgttatcatgcgttctggtggtatatataagtgttaccggaaaagtgaataactcaattatccccattgcatgtgctatccctaataaatacatcttcaaccgtttccaacagtttatatcttcttccactaaacaaaatttcgccaaggcttctgtctctgcataattcaaatccaacactttcgtgactccattactgtcggtaatcatatttaagaatgggtattcgtccagtaactcatggtcttctctctgtagctcagtaaattgcggcgattcttgcagtaatctttcacattcattttcaatataatctacgaacattcccagtaaaggcggtaagtgataaatatcaaaatcttctcttttatatacgaatttccaaccgctaaagctttgatttctgcataagacagtgccacttcatcaatatcctctacggatcttgccggacttttactggtcataatttgagatatgaatttttgcttattctctataatctgatatagatatgcatcaaatgttccttggggaattgaaattccccaactcactccccaacttttacccaattccatgcataaatagcgataatttacgataagtcaaaatttattccccaacactaaaaaaggtccaccggacctttttgtcgcatgcttggcaacgcaaaaaaaccttgaatcatcccattttcataggaaattcaaggtttttcgttgatttacatgataataatacggttcaaattcttatgcgaactgtaagattatgcgttcatctgttttgccaacttttatttactgttttctcaaatgcccattttataaggctttctacgctttcctcaattctgctcttccattttacccaatttccctttgggtagaaacttttcattcccgttgaaagcaaatttctcttattttgctatgttgggtactcttttatgcacactgggtagagtttttatttttctgaactttctgtttttcactcacgctaccaaactttgctatttcttcttcaaattttgtttctgtcacatgagtatatatgtcaatcgttgtactgtaatgctgatgtcccattagcatttgcactactttagcgtccattcctttttcaaagcacctgctacaaaatgtatgtcggattgcatgaggataaaggtctttaaattctatcggctctctgttttcctttaccgcttctattgcttcttgaaaattgattgcttttactactttcttaatttctttttctgctacattccgaataactggacttcctaaagaagtggtaaacaccaagttatcaaattctccacttgaacgccaacgatttccataggcttttttctgcctgttctgtttttctttttgagataacagaatttcttctgtttctgccataaacggaatacttctgtatgaattatgtgttttaggctttgttagtcgcatagtctttactccattttcatattgacaggataaagacctttgaatgttaatacatttcttattccagtctatatcttcccatttcagaccaccgacttccccaattcgcatacccgtcagaaacataatgtaaaacatctctttataccagttatgctctacttcctgcaaaaaccttgtttgctctgccattgataagaaacgtctttctgctgttttattttcccaaggtacattgatttcaaaacatggattgatgtctataatacgattattctttgcagactccaaacactcccgaactctgcctaaagcatctcgcatactggaagacgctctcccctgcttattcatatcgttaatgacacgttgaatatccaagttccgtatatctgtcactttcatattccctattgcttttcaaaatgtattataatatttgctacgcataggaaacacgcttgtttccttgatattaggaattttataatttgcaaaccattcctcaaaccattcattcagcgttattttctgacgtttcatatcaatattatttcttgcttcttcttttgccttttcaaacaatatttttaatttcttcaaatcaacatcatacaagttaatgtctattccctttatctttgctcttgcttcgtatctaccgtcctttctttgacgtaaacctgttcctaattcttttccttttaaatctttacccataatctctaccctttctatcaatcaaatattttgataaataaaaagggaacttctgtgattttaaccatatactactataagttcgcctccttttcaatcagaacttcaataactttttgcttgttgctctagccatgtgtctaataatcttctgttcgcataccaccgatacccaatcttcatggaaaacggacagtttctacttttcaagagttctcttgtctttgtttctccaagtccaagatactcacttacttcctttaaatttaataatgctttttctatacgattatcccctttcctctaatcttcttgcttttatgtaatcatcatacaactgtttctgtgtgatattcatttctccatttgctacaagattaccgatataatcccttttctctatctttccaacctctgcaaacagtttcaaagacggagcaacatacttttctaaccattcccacaccttttgtaaacttttcttctgtggttgcatggtaagtttaaccttacctatatctttcatcagttccgcccacgcttgataggttgggtaaagcctttttcgtgttgtcatgctgtctgtcggcttttctaaaaatcgtattttgctgttcaatacttccattgccagtcctgccacatctctatatctcaataattcctgtactacgctaactgccatttcctgccgaaatctcaactcatatctattccaattttcgtctaattctgttccatattttttattctgttcatatcctttttcataaaataccaatctcaaattgctggctgaactgccgagataaagactaccacctttactctgaaacacttcttctttcagttctcccgagtcgtgaaaatctatctcccttagttttgtggaaagcaatccctcttttgtccgtacaatcaaatcgggaatactcaaataaggttttctatcatctatcgccaaatcaatccgaggaacattgatatgatactggcaaactctgttcaagaaatcaaaccatgtttcctcattgagttgtaaaaaattctcatagttgcgacagcctttcccactcattaaaatctgaaagccttgatactgtgcatttcctgtcggctttagcaccttgatattatcgaagattgccacaacctcatgtcctgcaatccccttttcataacccgttacggtcataagttccaaaggtattctcagtacatcttctataactgcttctaacggaacttccttaatcgttatctgacaccagtctatcaaggcacttaatgcttctttctgtcgtattactcccctgttagtgtaggggagttctggaagaaaacttccgcttctttcttccaaatttaccatacctcctatctgcaatggcgttgccattgccctgccctcaacctgccgtttggtacgtcagaacgaggacaggaactttgaccgcctacatatttttgtttgcaacagggcggatacccttacaggtaatcttctccactaatacaggaaagtttcctctctgcacataaggggcatatactggttcttccagttccaccaccgcataaggctcaatcttcggaagttccgttgcttccaagcgaatatccacgctgttcccaagcttcatgcttccaagatgaagttttaaggcttccacttcctctgttttcttcttactgtctttatcatagcggtaacagttatccgcacccatgaaacgaagttctccaaatgcttcttttacctgttcttttgtcaatgtaatctgcatacacgttcctttctccccgttgaaccgataggtcagtttctcatattttcaatttcttattacgacgtcgtttgtggttcagttatttctgaacttaattgtatattagcacagacatatttgttttgcaatagtaagtttagttttttataaactttttattttcttttttctgaacttgtggtatagtgtccttagacgataagatatgaaaagttataacgagatatggaaagagagggttttcagatgaatacaatcgcagaacggattaaatttgccatgaaagcaaaaaataaaaaacaagtagatatagtcaaagatacaggtatcagcaaaggggcgtttagttcctatctttcgggacaatacaaccccaaagccgataaaatggaactgatcgccgactccttagatgtagatttgcgttggctttacggacaaaatgtgcctatggaacatacaagtcaaaacgataacgccctgcaatatgtcttttataacaactcctgctctgagtatcttcttgatgatttagatgatatatatatcgccatgatgacacaatatgccgccctcattccacgcttttatgtccttgtcaatcgtgctggaaatgcaatgcacatactgccactatttttgaaagaggatagttcccaattctatgaatgcccgtctgatttcttttattccgacaggcatacaatttttacaagagattttgaaagcattcacatggtattaacaaccgccacgatttactattatggaattgatacagcaacctatgaaccgaaagttaccatgctctcctactcacagactgacgactgctttcatatcgacaacggaatacaagacggtcacataaaagcatttgaaaaggaactggagaaagaagcactttacttaaagcataacgcccagtaacagacaagaggacttgcaaggtttccgacctttcaagtcctctgctgtatcatggtgctgttggctgtgtccgttccgtcaaggactgccctacggcgtatcggctacgccttgttccttgacctcactacattttctctttttcttgacacaacaaaagcctgcacgaattttcttcaatccgacaggctctcattctttcacatactctatcagttcttctattccacactccaagtaactgcacagtttacagattagttgtgcgtctaatctctgaaattcatttctgcaataacgattaaaattagacctcggtatatccaattccttacaaatggtattcttactaattcctttttctttcagcagttcctctatgtgaagttccaaatgtccatacttcattgcctcacctctacataaaagtatattcaataaatctttatgtagtaattcactatatagtgaggtactatatacttatccctataactatacagaaacagaggtatatcaaaatgaaaaagaaattgttatttgccactattattctagtcttgcttgcaggcattctctattacattagcttgcccgattatcttgtatttaacagtatgtcattcagcaatggggctaatcgtgataccgaactacaagttattgtatatcaatactggaatacagatgaagtaatagcggaaatcgaagcagaacataatcaaatcaacggaactcctactattcttacaatcaatctgtatcactctaaatggtcttttcgcaatggatatgaaccattttatagtaccactatcaattataattaaaaagaaaaagcagacagtcaataaaaaaactgtctgcaataatatggaatttacccctttaaccctctcgcctgtctatccatatcttcaataacaatatcatagatttctccgatttgagaacaatattctaacactttccatggctcatttgtatgaaaatgaattttaatcaattcttcatctccaaccgccaataagcaatctcctttaaaattatttgtgaaatattcatttattttatcttcatcaagattttcgccttcaatcaaaagttgagtatcatatctaaattctaacatcctattatcctccaaattcacatttttcaattttacaaactgaagtttatcagattgtgtacttcataggggtaaacctaatcccgtctatttcttgctcgtctgattgtggcttaaatccgatatgaagataaaatggcttaccgtatggtgacgaatttaaagtaatctcgtgcaactttggagcatctttcaaaatatctgctaaaagatactgaaaaattgaagtagctacaccttgacgatgatattctttctttgtgaatgctaagttgatatgcttcctgtttgaatacataccgataattccaatcattttacccttgtcaaacgccgcatatatagggcagataccttgttgacattttgaaataaattcatcattttcaactatatctcgcttgaatgtttcaattccctccggtttatagtccggtgcttcaaattgtaaaaacacttctaatgctaaagcaagggcttccattacttcattgctatgtatttttcgtatttcatacatatctccacctcaaattctaatttgtttatttctcttattctagcatattggtgctagaatataaatagtacaagtcaaaatgagaattccttattactgattttatgatactatgtatgtatcgcactgaaggaggatctcattatggcaaagcattatgataaacaattcaagatagatgcagtccagtactatcatgatcacagagatttaggactgcagggttgtgctttaaacttaggaatcagtcagcagtctttatctcgctggcaaaaagaactgcgcgaaacaggagatattgaaaaccgtggttctggcaactacgcttctgatgaagcaaaagaaatcgcacgtttaaagcgtgaactacgtgatacacaagatgcgctcgatgtattaaaaaaagcaattccgctgaatccttcaacggctgtctgtacattgccgatctgtgatccaaataacgagatcactggtccagctcccgcaagaactgctgcagtcttgccaagattcatgagctcatccgtactcatgttctgcagcttatcggctaacttaccaacactatctgtaaatccctttaattgcggaaccgcttcaccgatttttccggataaggattccaccacatccattccggtctttcccagacgcgggatcatttgtccaagattatttaagatattctttgccgctgtccagaatgtatcaaccaggttgttcgcactgattacaccggcttcaaagttttcccaagctgctttggcagaatttacagaaccttcaattgtagtcgctgcctctttcgaagtagtcccagtaattcccatctgcttttgcacaacactgatggcatttacaatatttccaaaggataagctacttgcatcgactgtaacaccgagttctttctggacatcagtcatctttgacgcatcagaaatgagacgtttcatctcttcctgagtaccgccataaccaagctttaagttatcaagcatggtgtagttctgttttgcaaaaccctgataagcgttctggatgtcacgcatgttcgtccccatcttattcgcattatcagacatatccacgatagctcggtccgcataagatgctgctttcgcagtatctccgccaagactctgtaacagcgatgctgaaaagcttgtcactgtttccatgtagttgtttgctgacattcctgcagtcttgtatgccttatttgcgtttgctatgaccgtattcgcactgtctttgaatagagtctctacaccacctacctgttgctccatgttggcaactacgccgagcgacgattttataattgccgcagctcctgttccgactgctgcaatcgtcccggtcattgctttgcttacaatagataatccagattttccaagttttccaagcttacttataccgtcattaaatcccttttcatttatcttggtatcaaaattcaaatatccatctgccatactatcgtcctttctgatagcacggctcaggggctcacaagtgcttaattcttaatttttatctccacctcccgtcggcatttgcggcattttacatacagtccgctgcacactgcagtatctgcgtaaacaagcagatgctgaccgcagtacggacacggataccactcacgccgtgtcggtattttaatttccatcatgagaacatatctccaatctcataatcatcaagctttcgctgtttctttttcagcgcaacagctctctggatcttcttgatccgtttacgttcgtccttatccggaaccgttcctggatcaatcgaacggtacatgatgcgttgtttaatctctgtgtcatccggcaaccagtcaaacaagctccggaactcccaccagtgcatataatcgatctgctgcaggtcgattccatatgcctcccggaacgctgcataaatgcagccggcatcttccgaaaaagaaaataccggcttccctcttttctgctgcccttcctcttcatcttccagatcatcctggtacatccttttgcacatcaggaaatctccaagtgcataaattgcagcttcaatatcatccggaatctgatccagataccactgcaacagaagtccgcacttcatccgccacggaaccgagtcgtcttcaaccagctccgtaaaacggatccattcacggaaatctgtcacgatcgggtagtactccccgttcaccttgacttcttccgggaactgctcatataaaatattcatgctctgctaccttccggtattggaatattttcccttaccatactgtttctggtagtttcttctctgctgacggtttccatttggctgtgactgcggatgcgggaactgctgcgttgtattttgatttggtacatacttatcatatttatcgtccagtttctttgcttctgctgtttcaaagtctaacagtgatcctgccgcttcagtgcacagcttgatactgttctttccgcaaaggatacgctccccggctccatcgccaaaaagggtatcgaagaacacataaaaacacgcgcactgcgcacggatgatatcactctgctttccggttatgggaacctttttccctgcttcaaacatttctgcttttgcttcctctaacacatctaaaaaatccgcatccgtgaaatccacttctgcttcaaaatctccaaatttccaaaggctcataggctcactctcccatttcttctttattttccgccagcagtgaatgtacaggtcttccatccgtctgtggtggttgcagtaccctttgtgatttctccggccgctttaaagctgcctttgtagatcagggcatctgtgccgtccccttcattgtccggaatgacgctccatgttctcttccgtgcggtacaggttgtctcagaggtcttctgctcaaacaaatctaccaccacaatatcaacctgtgcttctgttccgagaatctcatcatcggtaattgctgcaatcttttcatgtaccggatcattggtataccggtcaaattcgtaatcgatcgccggtgcgtaaccaactacgtccgatctttcagatgcttcatccacatactgccggctgtactctgtcgagttctttccatccgacagcgatgtaaatcccgtcattctggtaaatgtttctcctgatccgttagcatccataaaagccactctcttatgtctgccaactaacattttttcacttgccatttcttcacactccttacttataaatcaatctgcatatcatctgataccgtcccagatcgacctctgtactaaataaatagccggactgcatcacttccaccctaatagcattgtgaccgtccagctgaggtacgatatcatttaagttgttctgttctgtccactcttcaaagttctgataaaaaccactgttggcaataccggttcttgcatccccatcgtaggcttccttacttgtcagagcaaactggaactgtttcagacagctcccatccgtatattttttatagacaggatctgctccgatcggatcaatggaatactccattccgtctccgagataatcaatattgatcttcctgttatcgattccgggatacgttctcacatattcccggatgctttcgataatcggtttccgtttactgtccggcaagtttctcagctccttcccttatggcatctttgtggctcgctttcattgtttcaaaccatcttgccttagttttatgctcgtaatactgccggcgggcatatggggcaaggtattcaatagaaccagaaccaaccaccgtaccaagcgtcccggacttaatcagcatcccggttcttctcggtgtcaatggattcatgtagcgcagacactcggaatccacaaatgcctgcgcccttgaaaatccctccgctcttttctgagcaaatccgggcgcccattcaagctttgctgttacagatccgttttttccggccaccgtaaacactcttcctctcggtgatgtaatttggaagtctctcttctgtgccatcttactctcctccaattcgccagtgtggaagagagccgaagcggttgtcagaccagctcatcaccttgcagcgcttctggaacacggctttcagatctgcaggtctttcaatctcaatctgacactctcccaggacaatctgatcatcattctgtatggtccagtatccataaccgccacagcaggcgaactgatccggcggaagatacttctctgcttccggaatatccgcaggaatccgaattttgtaaacctccgcacttttcagtccgttatccgtaactgcagtcttatggtccacatggacgtggacaccatgcagaacggttcggttccaggtatcataatgtgtggaatcaccgcttactctgttataaacagtcacatctgcatttgtgatcacaccgcacccctacctttcttgacagccatccagtagggagaagataaggatataccgcatcatacgcctttttcttcaccatctcttccgctgtctttccatccgtctgctctgtgacataggtcacactgtagccatcgttattttccgacttaacaggtgaagtaccggcctgttgctgtgcattgtatttataatatacctccgctacagcacagaccgcattattcaccgcttcattttcttctacgaagatatctcctctagcgtatgtcaaatgccggatataagcctctgcctgtttcttagctttcttgaagtcctgttccgggatgatgttaccgccatattcatctgcgtagtatccatacgttgtctgcatggatcatcaccttcccttactcacctgttttcagaactgcacctgctttcagaactgcaaacgggcatctcttgtttttgtccgtcttaagagcgttgatcggattcgggatctcccatccgagacgcattactgcacgaagagcgaccatatcgttctgcatcaggttgtatgcgatagttccgtctgtgttctgtacaacaccctctgagaagagtttgaatgtgatgtcctgacggatagagtatacgagctgtgagaaatctccggaaatcataagcgcctttgacttatcaaacgctccattgttcgggaagttcatcggagatccgtcaagcgcatactgtgtggttccctgcagatcctgtttaaacagcggatccccgtttgcgttcttcaggcctctgagttttgctctcatggaaatgtctgccatgtgaccatttacaaagtatccgcagtcttcaatatgtgcgatcactccgtcctctgccatgatcttgtcatacagactgtctgtcgctcctaatgttacgactgctcccgcttttgtcgcggttgtaaccacgtcttctctccatgtgttcggtttattttcaccgaacagcactgcgctgtcgataaccttcccaaatgcttctgtaactctcggttttacttctccccagatgtcatactcagaatcatccagaactgcttccggaatcggaacaatgactgcaatctcttcggcagtgatgaacttcttgtcccatgcctgctttgtagttttcttctgtccggtatcaccgtttacgaaatatgcaatcggcagcatatccagtaccggcattttgtactgtctgcttgtcatgttcgccagtttacgacctcttgacaggacggctgactgtgcgatcgttccctgaataatctcattggattcctgagtcggaatcagagtctccgctccagtacgatcaatgatgtttacatcttcttcaaacaatcttaaattcattcttttattctgcatttactctacctccattatcttcgtgcggcagctctgatccggtcattgatagaagcgttcatgtttccaccagcaccattggaagcattacctgctgaagaatctgcaatccggtaagaaccgccaccggcaaatctcggattctccttcaggaacttctctgctgccttttcaaatgtcgttttatcatctaccattttggaaaccttgtaagtcacatagtccagatcatccgccttgacaccttttccggataaaaacttctcgttcttcatctgctggacttcatttctggaattttccagatcctgctgcagctgtgtcacattcggctgattctttttctgctgttccttataatcggcaattgcctgattcacctgctgctctgtcattccctgctgctgaaaataggaacgaagcgccgctttttcagctctgtctgctctcgcattggcaatctcttctgcctgcgcaaagctgtatgaaccctggtttcctgatccaccgacatttccctggctgccgttacctgctccagcgtttccaccctgtccaccagagccagctccgccgccgtcttcaaagagctgtaaaaacattctttttctcatgcttacctccaaatatgagtgttttccagagctttttctgtcttcatgttttggacataataaaaagcaccctcactggatgctcatttactcaaactgtatgcaattgtattcctggctgatcactgtgattcccaggaaccacgaatccaccagaagcttcccgccatctgacagatcttcccattcgatcacagtcattccgctggctgtttctccccggattctgtcacctgtcagatctttcagggaattgatcagattacatgttagcgctgatactgccgcacatacccggtcaatcccatccggactcttctggcaggcatgaccgttcatacggatgctgcgatctgttattttgattgttatcataaattctttactcctttgactctatgatggttactgttccttcaaagactccaaaatttgactgctgttggaatgtatgggtttcagcaatatcctcattagtcattggtcttgtaaggtaccataaagaatcatctttccaggtaatttcttccagtttctgatttggctcaagctttatcgttgtcttcccaccataacttttcgtggcggtctggcatccagttaaacctgctatcaatatgctgatagccgttaatactgctactgctttctttttcattaccggcctcctaaaaataagtacaaaaataccaccggtcatttcgactggtggcaactattcaaactctttaaatttaattccgtttttgcattcctcttcataaccagaaaaaattacatcctccggtattccatctggaaatgctttacaagtcatctcttcactattttcattgaaattactgcacagcatacactttggcaatgtcattctaaaccctccgccaatgaaggatatattttctgataagttttcttgcttcatctggaatccactctccgtttctatatctaacaaacgcctccgctaagcactctcgaccgtctttgcttctatctgcatattctgaaattcctgctatgaactgccttcttattttttcatttaactctatatattccacttctgatacgcagttctgaaatggcattatatgcgccatttcatgcgcaatgtaatcttcaaaattctttcccgccattacaccatcattgtaccatctcggcataatagtttcaacttttctataatcttgtttgtaattcaaaacaagtccatgtctcagcattccattttcatccaagtaagcacctgttgcaaaaatatcatttttctttagttttccgcctttaatagaatctaagtaaatcacgtattccgaatccaacttctttatcgccgcattgattttcgcttcaatttctttgctcaaacctgctttcttagcaactgtgtctggaatagaaattctcattttcagatcatactgactcggtgcaattcttcctcgtccatcaatataaatccgctctctttcctctttcagcctcattttccgagaaaacgccgcatattcatcaagctgtccctgatatttggctttttggagcataacttcctgccgatcagcaccgccatcctgaagcatctgcactttctcacgctgtgcccgcattgctgtctccatctggcgctgtctctgctttgcttcatacagagtatactctttgccccggaactcttttggtttgctttccttccggttctgttcttcgagccagtcatccgaccagttgcgttccgatattccaggaaagaacggatagtatgtgtggtagcagttagctcccagaagtccagtaactgtaccaagtccacaaactgaatacaattgctcttttgtccagacctgaccttgccataccgcatgagttggacgagctccggcatgccactcaacctcaaaatactctgttccaagcttcttggcattgtagtccgctatttctccggtaaggttcgctacaccagtcatcacagctcttctagcagccacttctacccggcttgcatatccggatccgtactcaatcttccgaagtccactgtttgtcagctgcgtgaccactcggcgtaatacgctaccatagtcaaatgctcctgtcacaatatcaaaacaggcattgtccagataattggtataaacctgtgacagcggtgttaaaacctttctgccgttataatccagataaaagccaattgacttagttacattctccagatcttccagactctgccggataatagcatctgtgatctgcttgagctgttcattcttctcaaacaggataaactctgcattgatctgttcgtaaatgtccttattccggacgtattcccagtcgatcaccttatcatacagctcaaacatttccggataagacgcatccagtgttttcttgatctctctttcgatatcctcggaagaatatcccagaatccgaagtctattgatctgccagtctgctgtactggtaatctcgccggtctttttgatccgccgggcaatgtcctgcaggatccgttcttccagacctatgtaccgcgctgcaatcttatcggcaacctgatctttgtattcttttcgcatcctactccatcacctgattctgctctggcagattcttttttgcctgttccactgtttcaccgtaccattttgcacggtactcttcatgccgcatcacgcccatactgacgtcctgacggtcctgctgacgctctgcgcccttatcctcaatgatagaatcatcgaaatcaatcacaatatctgtgttctggtccagtgtatttcctggcgatacatacatagtatcataaaatcagtaataaggaattctcattttgacttgtactatttatattctagcaccagctactattacaagtggtagtgaggaagactataaggatagatataagtatttttctcaaaatacaaatttcccgatagaaaaaggatatatttcagaacctaaaatttcaccgtttaattatgatgaacatgcattaatttattacacagaaaacatgccacatccaagtaaagaaagaaataaatttatagcacaaggtgttgaagaaataaaacagattttagaaatatctaaagggaaagcattgattttatttactgcaaaaagtgatatgcaagaggtatatgaaaagttaaaagaggctgtgccatataaggtattagtgcaaaatgcaggttcttctcaaacagatatacttaaagaattcaaaagagatgtaaactcggttttactaggtacaggagcgtattgggaaggaataagtgttgaaggaacagcattatctaatttaataattttccggttaccatttccggtaccagaaccaattattgattataaaattaaagcggctgataatggattaatggaagtattggtgcctgaaatgattataaaattgaaacaaggaataggtaggttgattagaagtgataaagattttggaattgtatcaataattgattcaagggtaggagaaaattctaatgcgttatataaatcagtgatatgggaatcattaccaataaaaaacagaacttctgatattaatgaggttgctgaattttataaaaattagcagagtaaagaaagtaagatatggaaatatttgcttcttgaaaatatagaagagattgatatatcattgtttataatacttaaaaagttaaacttagacggaggatgtagaatggaaaaaattgaaattgctgcgttgtcgcagattgcagatatattgtctgattctgaaaagagtcctattgtaccggaagaagatgtttggaaaaaaatattttataacgctgagttaggggaaatgtttgaagaaagatctccacaatttaaagttgtagagagttcatatggatggcatccagatgagaaagatgtgtattttaatgataaaacatataatggacttatagaatcttttaaagaattagaatatagaagagccgagttagtaaaattattaaataatattgcaagcaaaatgagtctaaggaggattcttgaaagtgatatagatgaaaaaataaaaataccgaggaaatatgattattttgaagattattttgaggctcaggatagagatggaaagaatgaaatcattaatgaatatagcaggtcggtatttaaaaaattaagaagaaatttaaatctaatcagtttagatattcactttgaagataatgaatttacaattatgtcatttactgaaaggaccgaagtaaatgattttgatttgaatcttattacaaggtggttggctgaaaaatatccagaagtttgcaagagttatgaagctgccagaaaagcatatagtagtggggatgaatctggatgtgttacacattgtcgtaatattcttacaggaatatttacatataataaacaagaagggcgtgaatggtatagtggattacaaaaggcttgtaaaaaggataaaaatattttaaatgtaaagaaccttaaaaatattaagcaaatgaagtacgattcacatagtgctgatagggaacatagatataagtatccaagatttagaatgatatctgaagtatatgcgattacatgtgatttgggagcacatattaatgaagggaatgtcactgagacaaatgatgaaataaaggttgatttagaagaagtaacattagaagatgctctgtggattttaagaatgacagaagatattctaatttggttatatcaaacaggaaatataaatgattaagtacatagctgattggttcaaaattaagaaccagtcggctttttctatgcccatttttatttatacatagctaatcttgtaaaaaggattggctattaaatttttcaaggaaggaggaaaccatatgaccaggtgtaaagtaatcgcccttgcaaatcagaagggaggaacagctaagaccacaacaacattaaatctaggaatcggtcttgcacatcaggggcgaaaagtgttattagtcgatgctgatccacagggagatttaacaaccgcattagggtggacgaatgcagacagtcttccgattacattggaaacacaaatgaagaagatattacaagacgaaccgtttgtgtataatgaaggcattttgcaccatgaagaaggagtagacattattccaactaatattgaattatcgggcatggaaatctcactggtaaatgccatgagcagagagcagactttaaagctgtatctgtcagatttgaaaaaggattatgattatattctgattgattgtatgcctagtttgggaatgttgactatcaatgcattagctgccgcagacagtgtaattgttccagtgcaggctcattatcttccattaaaaggtatgacacagttaatgaaaacaatcggtaaggtgcaaagacagctaaatcctaatctgaagattgatggagtattgctgacacttgcagatatgaggacaaaacttgcaaggacaacagaggatagtcttagagaaaattatgggaaacatatccgaattttcaaaacggttattccagtggctatcacagcagcagaaagcagtgcagcaggaaagagcatttatgagtatgacaagaatggaactgttgcaaaggcgtatgcagaatttacgagggaggtgattcagtgtggcgaaaagcagagaaataaacatgaatcttctctcagtcgatgacctttttaccacgcaggaagaaagagaccagaagaatcaggagtatgtaaaaaatatttctatttatgaaattacagacttcccgaatcatccgtttaaggtaaaaatggatgataagatgttggaaacaattgagagtgttcgtgatcatggtgtattagtgcctgcacttgtcagggaaaagccaacgggtgggtatgaaatgatttctggacaccgcagaaaaatggcaagtgaactggctggaaaagagacaatgccatgtattgtaagaaatcttagtgacgaccaagcagtcattgtcatggttgacagcaatcttcagcgagaagaaatcttaccatccgaaaaggcatttgcttataaaatgaaattagaagcaatgagcaggcagggaaaacgattagatattacttgtgcaccagaggagcacaagttaaaaggtgtaaaatcaagagacattcttgcagaacaaagtggagaaagtcgagaaacaatccgccgctatatccgccttacggagcttatcccggaaatcctagaaatggtcgatgacaaaaagatttctatgcgtccggcggtggagctgtcttatttgccgaaagaggaacaggagatattgtacgacaccatggagtcggaggcttgtaccccaagtcatgcacaggcaattaaaatccgcaaattttcagcagaaggcaggttgaatgaagatgttttgctgtcgattatgtcagaggaaaagccaaatcaggtagagcagtggaaaatcccgaagaatcgactgaaaaaatactttccatcgggaactacacagcagaaaatggaggaaaccattatcaaagcactggaattataccggaaacgggaaaaaagcagggaacgataggcattttgacaccaagggagaagtctatccgttggcagtcaacgagaaatcagctttttccgatttcccctccccacaccctacccctttggtttaccagcagattaccagtcgaaaagacaataaggagccgggaacatcttctctttcggcaggtcggagattccaataccctgcatgacaacagggagcaaacagcataaagcaacagcaggcgttccagacggacgtcttttttttgattgaaaagaaaggaattgtagaaaatgaagaagatatggaaacgagtgtgtacagggattcttgccctgaccacgattttaactgcgttaccgatcacatcggttcaagcagcggaaacacagtattggacagaatccgcagagagagttggaaatgtagaacatttgatgaatgacggaacaattaaaagcactttcaacgaaggacacatgcgagtagagggtgaaactgcctattgtgtagatattaacaccggattcaaaaatggatataagaccaggcatgatgcaagtgccagtatgagtgcggatcagattgaagatgtggcattatcgcttgagtatatgaaacagtatgcagtcagtcacagtaacctgagtgcaaatcaggcatatcttttagaacagtgccttgtgtggcagcgtttaagtgagcatttgggttggcagtgtgataatgtccgggtagtctattccgagatttcacaggatattcagaatgaggtgtatgccggagcaaaatcatttgtgaagacaaataagggacgatataaatgcggcggttacatttacaccggagaaggacaggacatcggacagttttgggcagaactgaatgtcggaaatgcgaaggtaaaaaagacaactgcaaatgagattgtcacaaatggaaatgcgatgtattccattgttggagcaacctttggcatatttttagaccagaattgtagtaatcagattggaacacttacaacaaatgaaaatggcgatacgaatgaagttgaagtgactgcagggactgtttatatcaaagagctttctgcaccgaaaggatataagctggatacgacagtacgcagtctgaaagttgaagccggaaagacagccgtattaaatgtttccgatgttccgaaagtaacagagacattggtagatctgttcaagattgatatggagacaggaaaagcaaccgcacagggaaatgcagcactgtcaggagcagagtttacctggcattattatgacggattttatacaaaagataacttaccagagaaagcaacacgtacctgggttacaaaaacggtggcagaaaagagcagtgacggaagtattcattatgtgacaaaactgtcagatgcttacaaagtatcgggagatgcattttacattcagaatgaaaaaagcgtattaccacttggaacactgactgttgaggagacaaaagcaccagacggatatttactggacggagcttatatgcaggcaggagacagtacagaacagataaaaggaatgtatctgacacagatcacagaggacggagaacttgcagtcctttccggaagcaaccagtattccgtatctgaccaagtaatccgaggtggtgtgaagattcagaaacgtgatttagagacaaaagataccaaagcacagggaagtgccacattaaaagatactacatttgcaattatttctttgaacgaaaattcggttctggtagaaggaaagctatacaaaaagaacgagacagttaagacgattcagacagggattgacggaattgcaacaacgacggcagatttacttccgtatggtaaatacaaactggaagaaaccaaagcaccggaaggttatctgactgacggggcaaaagcgattgaattttcgattacggaaaatggaaaaatcgtagatttaacagacgaaagccattccatttacaaccagattaaacgtggagatttagaaggagtaaagattggagcaggtacacataagaggcttgcaaatgttccttttaagattacaagcaaaacaactggtgagagccatatcgtagtgacagacaagaatggtcagttttcaactgcttctgattgggcgtctcataagaaaaatacaaatgcagggaaatccagtgaggacggtatctggttcggaacatcagagccagacgacagcaaaggggcattactttatgacacttatgagattgaggagttatcttgtgaatccaacaaaggtatgaagctgattccggtatttgaagttgttgtcagaagaaataaagtaaccatcgaccttgggacattgaccgatgagtatgaaaaagagattagcattcatacaaccgcaacagacaagaaaacgggcgaaaaggtaattgttgcaggaaagaaagtaacgattgtggatacagttactctggacggtctggaagaaggcagaaagtaccagttaaaaggctggcagatgctgaaagaggaaaatgcagaactgctcattgatggaaagcgtgtggagagtgattacacttttgttgctgacagcgagaaaatgaaagtagagatttcttatacgtttgatgcatcagaacttggtggacagaatctggttacatttgaagaattatatgacctgaagaatccggaagaacctgtaaaagttgtagagcataaggatattgatgataaaggtcagacagtcctgattacggagcgaaagatttcgattcataccacagcaactgataagaatggcaagaaggagatggaagctggaaaagatctgacgatcgtggatacggttactttagaaggactggaaattggtacaaactataagctgtctggttggcagatggttaaggcagaaaatgcaaagctgatcattgatggcaaagaagttaccaatgattatgaatttacagcggacaaggaaaacatggaagtgcagattgagtttactttcgatggcagcactcttggaagaaaacagcttgtaacctttgaagaactgtatgatataacaaatccggaagaaccgaaaaaggtaacagagcataaggaaatcaacgatgaaggtcagactgtaaccatcaaagaagtaccggaaataccaaccccagagacaccgggtactactacaaaaaccagtaacactccgaaaacaggagacactgcaaatgcaattttatggatagccattctggtattatcagcagccggaatcacaggagtttgtatctggaataaaaagaaacaggttaagagattaggaattgaagaaaagaaagaagaggaggagtaaaacagagggcggcgataagctgccctttgatgatgaaatgggaaaaaatcagaaagcaataaaagtattacagcgtttatttgatgccggatacggaacggaaaaagagattgtcaatatggcgatggatgaaatgcttgctttgccgggagtgaatgtagcagatctgtgcattatcagtgagctgcagaaaagcattaaggcaaacaaagtgataagctatttgtcagggaaaaaagaagtaaaggaagaaacgaaaggagcagattatggtggaacaacctaaatatttggaaatgacattatcacaattgaaatcatatgtggaatcttcagagagtaatatttttttggttgtagaatttccaaaaggagatcagaaggatggagaatgaattggaagttgtgaatatccgtctggtaaaagagccgtctctttatagtgagcagacgttggacagtccacaggctgttgtagaattgatggcgaaggagttatcgcaatatgacagagaagtattttgcatcctgaatatgaaaaataatggacaggtaatcaatatgaatctggtcagtgttggaacaatcaatgcatctttggtaattcccagagaagtttttaagagcagtattctggcaaatgcttctgcaatcattggacttcataatcatcccagtggtaatgtgaaaccatcaaaagaggatatgattgttacgagaaagctgcagaagtgcggacagctattggggatagaattgctggatcatatcattgtcggtggaactaatggaaagatgctcagcttccgagaagaaaagatgttgaatgtgacaggaaggatggactgggagagatagaagaaaaaagaattagaagtttttatttattgtaatatttcatgtagcggcattagtaaaatagtgtcgctacaaaaagctgacttatacattgatattatatgcataactcaaaataaaattgttaaaaatagaaaaagaaacaatatataacgaaaaaatctctaaataagaaaatttacattgactgagagaagagtaaaacatataataaaggtggaggtgtataagaatgttagtaaaagtaagtgttgaaaattttaaatcttttgataaagcagcagagctgacaatgatttcctcaaataaaatacgaacaaatgcaaatcacaggttaaagataaaaagtacccagttattaaaatatgcagtagtttatggagcaaatgcatctggaaagaccaatctggcattgttctttaaattttttaaagatagtgtctgcaatggtattccgatagaagctacacagatgttttgtaagaatcggcaggagaataaggaacgagaaagtagttttgaaattcaaattaaacagaagaaaaataaaataaaaattacaggataaaccaatctgacagggcaggagatgtgcataaagcagcttctgccctgtctgtatataaggagaagaatgatgagacgtttttatacagcagaatcagtaacagaaggacacccagacaaagtatgcgatcagatagcagatgcaatcttagatgaatgtctgcgttacgatccatcttcgagagtggcgtgtgaagtccttgctacaagaggaaatgtgtttgtagcaggagaaatcaccagcggatatgaaccaccagtgtttgatgtgatccgaaaagttttagaagagtgtgggtattgtacagatgggatagaaatggatacgtttgtacaccagcagagtccagatattgcgaaagcagtgagtgtgtcgaaagaatttcgggataatattggtgcaaagataagagacagaagcaggggagctggagatcagggtgttatggtcggatatgcgtgcgatgagactccgcagcttatgccaatgccgactgttctggcacaccggatcacacgtgaactttcggcttgcagaagaagcggatatatcaaagatatcttttctgatggaaaagcacaggtaaccgtagaatatgaagatggaaaaccagtgagactggaaagtgttgttgtttcctgccagcatggtgcagaaaagagcctgaagaagttagatgccgagattagagagaaagtgcttcgctcagcactcagattactgccgccggatgaggatacgaagattctgattaatccgtcaggaaaatttgtgtgtggagggtttgatgcagataccggactgacggggagaaagctgatggtggatacttatggcagtatgattccgcatggcggcggtgcattttcgggaaaggactgttcgaaagtagaccgttcggcggcttatatggcaaggtatatcgccaaaaatatagtagctgctgagtttgcaagcaagtgtcaggtgtctctggcttatgcaatcggagtagcagaaccggttatgattgaggtagatacctttggtacaggaaaagtgtgtgcagatgattgtctggcggcagcaatcccactggtgtttggagtgacacccgttcagatcatggaatcccttcgattgaatcgtccgattttccggcagacggcagtttttggtcattttggaagaaaggagtttccttgggagcggacagataaggtactggctcttcaggatacgattctgtaatgccttgggtaacagaagaagagattcaggcagcaaaaaatatgactgcgtatgagtatttgcgaacacatcaggcacagagactgcaaaagacaagaaccagaaatgaatggcagttgacggaccatgacagttttaaaatcaatgaattgtcgagtaaatggcattggaaatccagagatatcgggggagtgtctgcactgcggttcctgattgaagtggatggaatgaaatttacagatgctgtaaaactgctgtgcgaagagagtccgtcttttattccgacacagtctgccgaaaaggaaaaaccactatttaaactgccggagagatattgtaattgcagacgaatcagggcttatttaaaccacagaggaatcagcgatgaagtgatcacatattgtatttcacatgaaatcctttatgaaagtgtcccgtaccataacgcagtttttgttgggaaagatgaatccagaaaagcaagatatgcattcctgcgaggaatctatgaaaaaaacgggaagggattcaagatggagcagaccgggagtgaaaaaaagtacagcttttgcattccacctgaaagagaaacaaagcgagttgccgtatatgaagcgtgtattgatgcattggcacacatgacactggaagaaggaaagagggataaatatcgtctttcccttgggggaatcgctgctccgaaagaaaacgcactgatacagagtgaacgttttaaaaagccgccggacgcactggaagagtttctgaagaaccatccggaaatcaaagaaattgaaatatgcaccgataatgactttgccgggagatgggcgaaagaacagatgaaaaaacattacgagggaacgtatcagattatctgcaatctgccggaaaaagaaggggaagattatgcagaccttgcgaaagaaaaaaagcaggcaaataaatgcagggacagaccattggaaagaaggtgatagagaatggaagaaaaaggaacgatgcacgtacatctgttgacggagctgactggaaatctttattcagaagaatccgaatgggaagaagattggtcggagagtgatgaatatggaatgccgttagatggaacagaacttgccgattatgaagaagtcatccgagaagaactggaacgttatggggaagatgatctcatgcagtattttgatggaagtgagtccattcagggaaagatacaaagtgcagttgttacgatagaaaacaaagacggaatcctgtacggctgtaccaaactggaattaaatgaatttttaagtcaggaagagctacaggaattcaccgaatacattacaggacagtacagtgacggttggggtgaaggatttgagcagagggatataaaggtggatggtggaacgctgaatgtgcatttttggcatccagatatggaacagccgaaaatgtatgaaaagaaaacagagcagattccgacaaagcctgagaaacaacgtcccaagttacagttccttggacatgatgggaatattttttccattatgggcgatgcctcaactcttttgaaaaagaataaacagacagcagaagcaaaagaaatgtgtaaaagggtattggaaagtggggactattacaaagcacttttgattatcagcgaatatgtggaaactgagttgagtccaccaccaaaagaaaataggaaggcaaagaagaaacagcagccggaacggtgaaaggagagaacgtgagtaagtataagattacagagattgaacatccgaaatatccatggctccatcgaatacaggcggtgtcagatgtgaatgagaaagtaccaaaaggaacactgggcggttttatagagaatgaaaacaatctgtcacaggaagggacttgctggatttatgatgatgcaatctgttgtgaaaacggtgaggtaaaggaagaggctgcactttatgatggcagtctggtcagaggttatgctgttgttaccggagatactactttttatgacagagcagttgcgaagagagactgttatatctgtggcggtgagataaaggaaaatgcggtaatcagtggaaaagcatttattgatacggtaggagtaaatgcacctgttatcggtggagaaagccatgtgtatggagaagtaagaggaaatatctatatcaaaggggatattttcccttgggatatatttaataaccacacaaaagatatgttcttatatgaaaatggaaagtggagtgctttttctgttcctgagaaactgaaaccgccacagtcctaccagaaaagacaaacaaagaagaaaaatcagccggaacgctgagaaaagaaaggatgatgcctatgacaaatggcctgagtttggaagaacttatgaaagagggaacatacccagaggaatatgctgaaggggaaaactggaaaatattacatggagatacattaaaactggtcaaagcattccagccgggaatctttgatgcagtcattaccgatccaccgtatgcgtccggtggaacaaagcagaatgaaagaaatcgtactacaaaccagaaatacagcagtatgagtgctgcaaatgcacttccggattttgatggggacaataaagatcagagatcatggacacactggatggctgagtggctttacgatgtgcggaaagcctgcaagaaaggagctccgatctgtctgttcattgactggcgtcagtatccatcaattaccgatgcattgcagtgggcaggatggatttggcgaggaacagcggtgtgggataagggaaactcccgtccacagaaaggccgtttccgccagcaggctgaatacattgtgtggggcagtaatggaccgatgccaatcaaccgtccggtatcttgtctgccgggagtcttccgatatggaaatccgcagaaccggattcatgtgacagagaagccgttgcagcttatgaaagatgtcatccagatttgcgaaccgggaggtctgatcctggacccgtttgccggagcaggaacgactgtccttgcagcggttatgacaggctatcgtgcagtaggaattgaggtaacagatgcctactacaaactgggaagtgacagagtgagaattgcattagaagcagagcagaaagaggatgaaaagtagccgggatgtccaattggacatcttgttttttatagagaaaatacttggcatccaactggatgcaggaaggagatggagcgtatggaacaggcgctggcttatgtgtgctgttcagcagaagaaagtcgggtaaaagtgcagaaatattgcagaaaaatctatgaacttgggtatgtaccaatctgtccgagatttgtattctcaccatttttggaagaatccgatgcagaagatatgcagggatatggaagaatgtcccatatccttttgcggagatgccggatggtagtcgtatgtgggaaagaagtgacaggaacaatgaataccgaaatcagtatggcagacagactccatatcatttgtacgacacttgatggactggtacagataaaagaatcaaaataaatcggaatcgagttaatccggtactacagaaactggtggtactcgttttgcaagcatagcgtttggatatccaaacgcactttggggagaaccccaatcccccggacacagacggaaatggaaaggaaggatcaagtcatgttaagaaacggagtaatgattgtaatcgcattgatgagcggaggatttataggagtggtagtaacctgttgtatggttacggcgaaaaaatccgatgaggaacttggcggtatgatgaaagaggaagagaaaaaagaagggacggtgatgcaatgcgaaaacgaaaccatgtgatccctgtacggcttaacgcaagggaagtcagggaactgaatgagcaggtcgaaagaagcggtctgagcagggaagagtttatgcgttcgttgattttgggagcgcaggtacatgccaaaccctgcgagcatcaccccgaattgctccgaaaaattgcaggcttatgcaacaatgccaatcagcttgcccatgttgccaatgcttctggaatggcaagtgagcagagcattcaggaaatgctgcgtcttaccaaagaaacatggcatctggtaaaggaagagtggtaatgccggatggcttatacaagtgttatccccgtccaccgcctggaccgttctatcgaatatgtaaaagataaagaaaaaaccacacagaaagcggactctctggaggctgccatcgattatgcaatgaatcggaccaagacagaacaggcggtttttgaagataccatcggatgtaccaatgaaaatgcgtatgaagatatggtggcaacgaaaaggagattccataagatgggcggtgtagaaggatatcatctggtacagagttttgcagaaggtgaagtgacaccggaactggcacatctcatcgggcaggaactggcagaccggctcttaaaaggacaatttgaagtagtcataacgacacatcttaataccagacactatcataatcatattgtctggaattctgtaagcatggtggatggacataagtaccatagtaatgccaagagttattatacggagatccgcaagatttccgatgacctgtgcagaaaatatggtctgtctatcattgaatccaatcagaaaaaatcaatcccttatgtacagtggaaagcagaacaggaaggaaagccgacatggagaacggcgatccgtttggatatcagggaatcggtacaggaaagctactcctggtcacaattcctaaaagagatggaaaagcggggatatacatggaaactgaaccggaaatacatctctttaaaagctccgggaatggaacggtatatccgtctgcgttctcttggaaaaaactattccgaagaggaaatacgtgggcagatactacagcccaaggtgaaacgagtctatcaaaaggcagtacagattcatcccaaaaagaaactgaccgggattcaggcactgtattattcctatttatatcaaatgggggtactgccaaaaagaccgaaaaggagtccatacgctgtcagagaggatatccggaaactggaccgcaggattgaacagattgaatttctaatgaaacatgacatcataaccagagagcagcttgccgcataccgagagccattgcaaaagcagattgcggaacttatgaaagaacgcagaagattgtatcggaatgggggcagggagactggggaagaacgattgtccgaaatcaatgaggaattgaagcgactccgtaaggaagttcgtatgaccgttcagattgagaaacattccttggaaatcgaagcgaaacttcagaaagcagaagaacagagccagaatgaaaaacgtgtggaagataaagaaagaatgcagaagagtcaggaggtgagataagtatgaattatggagcagaaccggctgatcaggtggtgcggtacagtctggaaggaatggaatactctttgaagattaccggaaatgtggcaaagcacgtggcaatctttattgcggccgcattaaaggatcagaaaaagacaagagggaaaacaaggcttaccagaatgttaaaggaacagcgcccgatgaaattttttaccgttccgggtgaccgtttaaaagaatttgcaaaagaagccaaggcgagaggtatcttatatgtagtcatcaaagataaggtgaatccggaccagacagaggtcatggtatttgcagatgatgccgcgaagatgaacagggtattagaccggatgaatctggattttgtaaaagcagaatcaggttctatggttacagaagcagtggaaaaagagactgcaccggaaaagacagaaaaccagatggaaaaagaatcaagggagaatgtacggacagagaccgttgtcctgccggaaggcaagatagaatttgaactggacgatgcggaagaaatgttccagatcggggatgaggctttcccggaaggaaattttacacaggcgcaggaaggggaagaaaagaatccatccgaacctttctcgcgcaacagaaatacttcttccgatcgggaaactagctggaaagaaaagaatgaaaaaccatctgtgcggaaagaactcggagatatccgcaaggagcaggaagagaaacgtaaacggccggacagacggaaaaatgccagagagagcaggaagaaacgcaagaatatgaaaacgaaaggcaggtaatgtatatggatttaacagatatgatttcaggtggaacggaagaacagccgattcctgaacagaaattgacgaaagaagaatatgcagccaaaaaacagcaggaaagagaagaggtatgggctgaagtagattcacaggcacagggagtttttcaggatggagaaaaactgaaaggttttctggattttatggcagagtgtaatacacagagaacaccgaatctgcttttgatctatggacagcatccggattttaaggtggtaaggtcttatgaacgctggagagaagaacaccgttcggtaaaagcaggggagcatggcattacttatatgatttccactgaatatgaaaaagatggagaaatgcggagagggtatacgatcggaaaaggatttgacatcagccagatgacagggaagccattggaagaacgccctcagcgaagcctgacagaactggtaggagctgccttaaaagaccagtcggtacgtgtgcagattgaggataatctgccagacaaagtgcaggcccagtacaatccaagatatcgtaccatctatatccgcaacggaatgagtgaagtaacgacattccatgcactgaacagagaactggcgtgtgcagcgatggatcagcgtaccggaacctacagccgacagaaagtcagcgcacaggcttattgtgctgcctatgtgattgcgaaacgttatggtgtagatgttaccggattcaatctggagtatattgcacagaggaatgaatgtggaaagaaagatccgcaggaactgagagaatttttaaatgatgtccgtcaggcttcctacagtatccgaaaccatatcgaacgcaattttggtgcaaaggaacaggagtatgtaaccgatgagttcgcaatcggagaccctgtaaaaacaccggaaaccaaggatgaaaaagcatacaaaaaaatctataaaaagactagcattttgtataaatgtgtgctatagtaatcatgtcagcaagaaagatgctgcaaaatgaataaaaagatgcagtcaattagatagtaggttgatatttcctgcgagagaatcatttataaagatatttgataaatggtcgccgaagatgcaaaccgtagagcagtaaagctcgttgaatggcgaaactttcaggcaaaaggatcgggaaaggtactacactctgaatccggaattaccgaatttacaaggagacagaaaggacgtttaaaacagagaagttgttttggcgtccttttttgataccagatatatgttaaaaaattatctggagtatttcagacacagggagtcaaaaaagaccgcataaacggacaggggacgaaaggaagaagcggctatgaatactggatttatgattatcacaaataatccactggtaaaagaaaaactgggggaagattatcatgtggaatacgaagaactttcttatgaggacacacttaaaaaggttcagaagatgatcttccagggataccgacttttgacacatccgctgtccggaagcgtaaaaccgaatgagactccatataagtcggttatgctctcagaaacgccggaaggtctggatgcacaggcgatgcagatcattgcaagcgccattcaggcgtgcggtaaatttcagtttaagtctgatctttataaacctcaggtttatgcagactttcagcttgtagattacacattgatctcaagtgctctgccgtcagcggaaagctggcgctaaaaaaaggctgtagaagtacatgcggtttggtgtacttttgagcatacaacaaacacattcaaaaaaggagggaatttacagtgaaattagaagtaggtcacatttttattaacgacattcagttcgcatctgaatcaaagatcgaaaatggtgttctttatgttgacgaagaagctgtaaaggcaatcgttcttgaggacgaaaaaatcaaaggtgttaaatttgatatcgcaaaaccaggtgaaagcgttcgtatcactccggttaaagatgttattgaaccacgtgttaaagttgaaggaagagggggagtcttcccaggcgttatcgcaaaagttgacactgtaggtagtggtaagacatatgcattaaaaggaatggctgttgtaacagctggtaagatcgtgggattccaggaaggtatcatcgatatgtctggcccgggtgcagaatatacaccattctctaaacttaacaacttagtagttgtttgcgaaccagttgaaggaatcaaacagcatgaatatgaaaaagctgttcgtcttgctggattcagagtagcagtttaccttggagaacttgctcgtgaacttacacctgatgaaacaaaagtttatgaaacatacggaatcatggaaggaaaagaaaaattcccgaaccttccgagagttgcttatgtacagatgcttcagagccagggacttctccatgacacatatgtatacggtgttgatgctaagagaacactctctacaatcatgaacccgacagaagttatggacggagctatcgtatctggtaactgtgtatccgcttgcgataagaacccaacatatgttcatgaaaacaacccggttgtccatgacctgttcgaagaacacggaaaaacaatcaactttgtttgccagattcttacaaacgaaaacgtataccttgctgataagatgcgttcatctgactggacagctaagatgtgccgtctgttagaccttgatgcagttatcgtatctcaggaaggattcggtaacccggatactgaccttatcatgaactgcaagaagatcgaagctgaaggcgttaagactgtaatcattacagacgaatatgccggacgtgacggaaaatctcagtcactggcagatgctgatccggctgcagacgcagttgtaaccggtggaaatgctaaccaggtaatcgtacttcctaagatggataaagtaatcggaacagaagattttgttacaaccattgctggtggtaatgaacattctcgtcgtgaagatggaacaatcgaagttgaaattcaggccattaccggtgctacaaatgaaaccggatttggatatctgagtgcacgctaggaatggaggacgtaaagataatgagtaaaattaaagttgtacattatatcaatcagttcttcgctcagattggtggagaagaaaaagctgattatcctgctgaacttcgcgtaggcgaaatcgttggacctggacaggctctgacacagcagtttggagaagaagcagagatcatagctacaatcgtttgcggtgactcttacttcaatgaaaaccttgacaaagcaaaagctgatattcttgaaatggttaagagccagaatcctgatatcttcatcgctggacctgctttcaatgctggacgttacggtgttgcatgcggaactatctgtgatgcagtacaggaagaactcggaatcccggcagtaactggtatgtacgttgaaaacccaggtgctgatatgttcaagaacaaagtttacacagtatctacaaagaacagcgcagctggtatgagagatgcagttaagaaacttgctcctcttgctcttaagatcgctaaaggcgaaaaaatcggtgcttcttgccaggaaggttacatgccgaacggagttcgtgtaaacttcttcgaaaaagaacgtggatctaagagagctgttaagatgctccttaagaaactggcagacaagccgtttgagacagagtatccaatgccaacattcgaccgtgttgatccacagccagctatcaaagatcttagcaaggctacaatcgcactttgtacttcaggtggaatcgttccgaaaggaaatccggaccacatcgaaagttcaaatgcctcacattacggagaatatgacatcacaggtgttatggatcttacagaagagacatacgaaacagctcatggtggatatgacccggtatatgcaaacgaagatccagaccgtgtacttcctgtagacgttatgcgtgaattcgaaaaagaaggcgttatcggaaaacttcacaacaaattctatacaacagttggtaacggtacagccgtagcttctgcaaaagctttcgctgaggaatatgctcagaaacttatagcagacggtgttgacgcagttatcatgacctctacttgaggtacctgtacacgttgcggtgcaacaatggtaaaagcaattgaagcagctggactcccggtagttcatatgtgtacagtaactccgatttccatgacagttggtgcgaacagaatcgttcctacgattgctattcctcatccacttggaaatccggctcttgaaaaagatgaagagtatgctcttcgtaagggccttgttgaaaaagctctgaaagctcttacaacagaagtagacggacagacaatctttgacaactaaatcatagttagaaggtcatgtaattttattaaaaaaggagagaacgttatgagcaaagtttatgacgtgatcgtcctgggtgcgggacctgcaggcttagctgcaggtctgtacgcaggaagaagccgtctttcaacactggttattgagaaaggtaaagatggcggacagatcgcaatcacagatgacatcgaaaattatcctggacagatcgtagaaggggaaagcggtccttctcttatcgcaagaatgacacagcagtgtgaaaaattcggcgttgagagagcctcagatgtaattaacgaagtacacctggacggcgatatcaaagtactgaagagtgcgaaggctgaatatcagtcaaagacggttatcatcgcaaccggagcttttgcaagaccaatcggatgcaaaggcgaaaaagagttcatgggcaagggcgtttcttactgcgctacctgtgatgcaaacttctttgaagattttgaagtatacgtagtaggtggaggagactctgctgtagaagaagctatgtaccttacaaaatttgcaagaaaagttaccattattcacagacgtgatgagcttcgtgcagcaaaatccatccaggaaaaagctttcaagaacgaaaaacttcactttatgtgggatacggttgtagaagaagttggcggtgacggaatcctttctgagatgactgttaaaaatgtgaaaacaggtgaactcactaagatcgtagctgatgaagatgacggaatgtttggtgtattcggatttatcggaacacttccaaactcaaagatctatgaaggaacaggtcttgagatggatgaaagaggatatattccgacagatgcagatatgcacactaatatcccaggcgtattcgcagcaggcgatatccgcgttaagagcttaagacaggttgttacagctgcagctgatggagcaatcgcagctacacaggcagaaaagtatattaacgaattaaaataataaacactttttaatagagtgaggaggacatttgacatgttagaagtagataagaaaacattcgaagacgaagtcttaaaagcagaaggttatgtattcgtagatttctttggtgatggatgtgttccgtgccaggctctgatgccgttcgtacacgaaatggcagataaatacggagataagatcaaattcacatctctgaatacaacaaaagctcgtcgtcttgctatcggacagaagatccttggacttccggttatggctatttacaaagatggcgaaaaagttgaagaagtagtaaaagacgatgctacacaggaaagcatcgaagcaatgattaagaaatatatctaatcattatttaattaggtgagccgcgcacagccggcagagatccggctgtgtgctcacaatatataatcgcgtaaagcgtgtaaaactattatcaaaacaaaattttaaaagaaaggaaggaggaaaagacatcatggcaattttaaaagataaaaaagttgttattatcggtgaccgtgacggtgtaccgggaccagcaatcgcagaatgcgttaagacagctggcggagatgtagttttttcttcaacagaatgtttcgtctgaactagcgcaggcgcaatggatctggagaatcagaaaagggtaaaagaatttgctgaggagtacggcccggaaaacgtagtcgtaatcgtaggcgcagctgaaggagaagcagcaggacttgctgcagaaaccgttacagcaggagacccgacattcgcaggtccgttgacaggggtccagcttggactcacaacttatcacgtatgtgaaccagagttaaaaaaagaatttgacccggctgtttacgatgaacaggtaggcatgatggaaatggtccttgatgttgatgatatcgtagacgaaatgtcagcaatccgcaacgaatattgcaaatacctctaagataaagagggatttatccttcgaagcggaatatctgagatagaggtacaggcggcaggattcttcctgtcgcctgttttattgccaggcatatcgggaacatgctggtattgcattagtgaattgcctagcatctcggaagcgtgccagtgatgcgcttctgataaaagcttgtttagcgcattctgcccaaaatcttttaaatcaggacaggtagattatacgcgcatatcacggagaaatgaatgatggtgacattcgtaaaaagagaatgtcaggaaaggtggaaaccagcgatgaacagtgtaattaaaggagcaggatatgtactcgtacataccccggaaatggtagtttacaacggaacaacacagacaacagaaagagttgttaatccggaatcagaatatttaaaagaacttagagatcatcttcggtcatatgatacatgtgtaaattattggccgaatcaggtatatatcggaaatgcaacaccggacgaccttgcccaggttgaatttccttactacgataaagtaaaagaaggtgcagagcgttacggaaaatacggtgagatcatgccggaagacgaattccttcttttagctcaggcatgtgacatgttcgaagttgttatgcttgaaaaaggatttgtagcagctacaaaagaaaaatttgcagcagatccgatcatcacagatgatatcgtagaaaaagtaatcgagggatttgaaatctcagaaatcgaacactttgtaaatgaagagcatgctgaaggtctgtatcatgaaaacaaactggtaggctgtgtaaagagagcgcatgacattgatgcaaacctttcagcacatgttatgcatgaaaacattatgagtaaggcatccagtgtgctcgccctcctctatggtgtaagaaacgcaggaatcgaaaagacagacgttgagtatgtcatcgactgtgcagaagaagcttgtggtgatatgaaccagcgtggcggtggtaacttcgcaaaagcagcagctgaagttgcaggacttttgaacgcaacaggttctgactcccgtggattctgtgccggaccatctcacgcactgatcgaagcagcagctctcgtaaaatcaggcgcatacaaatgtgtagctgtaacagctggtggttgtacagcaaaacttggtatgaacggtaaagaccatgtaaagaaaggtcttccgatcctggaagactgccttggcggattctgtgtaatcatcgcagaaaacgatggtgtaaacccggaaatcaacctggatatccttggacgccatacagtaggaacaggaagtgctccgcagaacgtaatcggaagccttgtagctgatccactggaaagagcaggacttaagatcacagatatcgataaattctctccggaaatgcagaacccggatatcacaaaaccggcaggagccggagatgtaccgcttgctaactacaagatgatcgcagctctcgcagttaagagaggcgaacttgacagaaaagaacttgcaagcttcgcaggagaacacggactgacaggatgggctccgactcagggacatattccttcaggtgtaccgtacatcggatttgcaagagaagatatccttgctggaaagatcaataaagtcatgatcatcggaaaaggaagtctgttccttggacgtatgaccaacctcttcgatggtgtatctttcgtaatccaggcaaataccggtgcagaagataacagtggtgtatcagaagaagaagtaaaaggactgattgcaaaagcaatgaaagattttgcagcatcactcatggcaacagaagaataagaaaggtggacaaacaaaatggcaaatagtattgaaagaatgattgccgacacctttatggagatggcgcagggactggagacaggaagcttcggaaagcgcccgaaagttgcactgaccggaatgggaagcgaacatggagaagaaaactctatggcagcggcaattgaagcggcaaaagacggaattgatgtatattatatcggaacattagaagcagaaggcgttacaactgttaaagtggctaacgatgaagaaggtcatgataagatggaagaaatgctgaagaatggagaagtagatgcagcagtaaccatgcacttcccattcccgatcggtgtatctacagtaggacgctgtgtaacaccggcaactgcaaaagaaatgttcatcgctaatacaacagggacatccagcacagaccgtattgaaggaatgatcaaaaatgcgatctacggaatcatcgctgcaaaagcttgtggcaagaagaatccgaccgttggtatcctgaatgtagacggtgcacgtcagacagagaaagctctgaagaaactgcaggagaacgggtatccgatcgaatttgcagaatcaggaagagcagatggcggatgcgttatgagaggaaatgacgtccttcaggcatccccggacgtcatggtaacagattccctcacaggaaatatcatggtgaaaatgctttcttctttcacaacaggcggaagctttgaagctacaggattcggatatggacctggaatcggagaaggatatgaacagcttgttatgatcgtatccagagcatccggagcaccggttatcgcaaatgcaatccgttacgcagcacagctggtaagaggaaaagtatttgaagtagcgaaagaagaatttgcagctgttaagaaagctggattaaaagaaatccttgatgagcacaaagcttctcagaaaccggcagcggctgaagaagaagggtgggccaatgtattatattaagaatggtctgaataaaaactggcactggcttgcatatttgtttgctgcattcggtgtgctgacagtatttggaactggaaatgcgacacaggtcaatacgattacgacagcaattgattccgcattattcaattacggggtgattggagtggatgcagcaaagacggtcaatcttgtgatcggaattgtgcttgcggtgttgattgcactgatccttctcggtggaatcaagagaatcggacaggtaacggaaaagcttgtaccgttcatggcggttatctatgttctgttagctgccggagtggttctgttgaatttaaaaaatataccacatgtatttgtttcaatttttgaaggtgcatttacaccgacatctgttaccggaggggcagtcggaagcttctttatcagtatgaaaaaaggtgtgtccagaggaattttctctaatgaggcaggtcttggtaccggatcgattgcacatgcatgtgcagatacaaaaaaaccggtgaaacagggattcttcggaatctttgaggtatttatagatacgatcgtaatctgtacactgaccgcactggtaatcctgtgcagcggagttccgattggttacggggaggcagcaggtgcggagcttacgattcttggatttacttctacatatgggagctgggtatcgatctttaccgcggttgcaatgtgctgctttgcattttcaacgattatcggatggggactttatggaaccagatgtattgaatttttatttggaacgaagatcaacaaaccgtttatggtgctgtattcactggttgcgatcgtcggagcaacgatggatcttggactgatgtggaatattgcagagacatttaacggactgatggcaatcccgaacttaattgcagtctttctgttatcaggagttgtggtaaaacttgtaaaagaatattttgcaggggaaggaaaagacgcataaagaaatacctgacagaaagctagaaggctttctgtcaggtgttttttaatttccaaaatcaacgccatacattttaaaatgtgtctcaatacgctgtttggcttcccaaagaatctggacagcttctttttctttagactcggaaatacggaaggttgggatggatatacttaaagcagcgattggtgcattattgtaatcaagcgaaacggcgatacaatttaccattaaatttgtttcttcatgttccacggcatatccccgttgacgggtaagttctagctctttaagtagatcatttatggtagcgattgtgtgtggtgtatatgcagtgagaacttctggaaacaggctacgaatttcttcttcggatttataagcaagaagtgctcgccccaaaccagtacagtacaaaggaagctgctttcctacggaagacatcaggcggattggctgaggtgaatccttttttgcgatataaaataccatgtttcgagattggataccaagttggcatgtttcgttacttaatgcagtaatgttattcatctcctgttgaatgaattgtaaagaagtcttgcggttattataggctacaccaacagaatatgtagcaactccgatacgatagcgaagcgtatccttttgcatataaataaaattacgggcagtcatcgtatgaacaagcggcataatgctgctttttggggcattcagtgctttggcaagttcggtaagagtcattccttcctcagagttggaaagaagctccagtatatcgagcacccgttcagtagggcggtgttcagttgttgccattggtttaaatctcctttattaacattgaaataatctaaagttcaatcaagtatataaaaattatatcagatatttgtatggaattccagagctgtttgacgtatatgtagaaatttatatagaataattgtgcaaaatgataaaaataatgaattcatttaatgatatattgacaataaaatacataagtgctattttaaaagcatgaagtatgtaaatacatacggagtacgtatatacgcacaaatgaaacgaaaggaaaaaaggtaaagaggaggcaaaaaactatgattatgaactttttgaagaaagtaccggctgggatgatgattgttccgcttttgattggagcaattttaaatacgttctgttcgtcgatacttcaggtaggttcacttacaacagcaactttttcaaatgcaggtgcggcaacagcgatgggaattcagctggtatgtcttggaacaacgttaagatttaatgaactcggaagtgtgttaaaaaggggcggagtccttttgatttccaaatttgtggctggagcagtaattggtattgttgttggtaaagtgttcggtacagatggatttcttggattatctgcattagcaattatctgtgcggtaacaaacagcaatggttccgtatatctttccctgatgcagtcttatggtgatgaagtggatagtggcgcaatggcattactctcattgaatgatggtccattttttacactggtcgcaatgggagcttcaggacttgcaaatattccgattctttcaatccttgcagcaattacaccgatcattgttggtatgatccttggaaatcttgataaatcattttctgatttccttgcaccggcaggaccgattttaattccatttgtaggacttacacttggagcaggaattgatctttccgcagttataaagggaggaccgtcaggagttctgcttggatttatgactacttttattggtggagcatttattgtattatgtgatcggaagatttcaaaacgaccgggttatgccggatgggcagtagcgacaacagcaggaaatgcagtagctgtaccggcagttgtaggactggcagataagagtctggaagcatatgtaccacaggcaactgctcaggtagcagcatccgtagttatcacagcgattattgtcccaattgttacaaactggtgggcacataaatacggatgtccgaagttcccacttgaggataagaaagcagcaacaaagtagtatttgtaaatatcacatattaaaaaatgaaaacaggagatgagcaaaatggtagtaacagttaatgcagcaattattgatgaaaaagataccgtcgttgtagcaattgaaaagatcaatgcaggagatgaagtgatctggagagatagaaatggagatgtacagaagattaaagctataacagatgtaccaatgtaccataaagtagcgatcaaagaaatgccaaaaggaacagaagtagtaaaatatggggaacatattggtcttgctgcctgtgatatccatgtcggagagcatgtacatgtacataatgttcagaatcacagagaaaatctttaaaatacggaatataagaagacaggaggaagtttaaaatggaaaaaatgactttttggggatatagaagaccagatggaagagttggaatcagaaataaaattttaattttaccggcaagtgtctgtgcatcagatacaacaagaattatcgcgtcccaggtagaatctgcagttacattcaataaccagaatggatgttcccaggttccgtcagatcagcagttcacgatggatgtaatggcaggatatgcagcaaacccgaatgtatatggaacggttgttgtatcacttggatgtgaaaactgtcagatggatcttgtgttagatgcaattaaagagagaacgaataaaccaatccgccatttcattatccaggaaaacggaggaacgatttctacagtagaaaaagctgtccgtgcagcaaaagagatggcacaggaagcttctctactgcagaaagaagaatttgatttttctgaactgatcattggaactgaatgtggtggttctgacccgacttcaggacttgctgcaaatgttctgatcggagagatgagtgatcgtatggtagaacttggaggcacctcaattctttctgagacaacagaatttattggtgcagaacatattctggcaagacgcggaaagacaaaagaaatcagtgacagaatttaccagatcgttcatgactatgagcatgcaatcaagttagtaggacatgatatccgtgaaggaaatccttctccgggaaacaaagaaggaggacttacaacactggaagaaaaatcattgggatgtatccataaaggcggtcattcagaagtaacagcagtatatgactatgcaaaacaggtagaaccaaaacagggacttgttattatggacactccgggaaatgacccatcatcagtagcggcaatggtagccggtggatgtcagattgttgtattttctaccggacgtggtacaccgacaggaaatccgcttgcgccggtaattaagatcaccggtaataaagttacttttgcaaatatgtccgataatattgatattgatgcaagcccgtatatttacggaaccaagacgatgacagaacttggtgatgagctgatgaaagaaatcaaggaagttgcggatggcaagctgacaaaagcagaagctcttggatatacagaaatggcaatagcaagagtttgtaactatatgtaaaaatggggtggaaaaattgcgttataccagagtaaaagataaaaatggagaaattcatctggcagctttcgaaaaggaagaaaccgtattttttctggatgaattattcccggaattaaaagggaaaacgttgatagattttgttcatatggtaaatggtgatccgcaaaaagcagcacagatgatctgtgctgcagatggatcggtacatagaatggaagagcaggagatgcttacaccgattgaacgcccggttcatgatattctttgcgttggagtaaattatacagatcatctggaagagacaaaggaacatttggcaggagctgtgtcggatgaagtatccggtaccgtgtattttgcaaaaagaacaaaccgtattcttggggcaaatgaagagatccagggacggtttgatatcgatgaaaaagtggattatgaaacagaattagcggtcattataggaaaagaaggaaaaggaatcacggaagaaagagcagaagaatatgtatttggatattccgtatttaatgatctttcttcaagagatcttcagactagacatggacagtggctgatgggaaaaagtctggataattatacgatcatgggacctgtgatcgtagaccgtacagagcttccgatgccgttagaactggatattaagagttatgtgaatggtgaactcagacagaattcaaatacaaaatatctgattaaaaaaattccggggctgattgcagaattgtccaaaggcattactctggaggctggtgacattattgcaaccggtacaccagcaggtgttggaatgggatttacgccaccaaggtttctaaagaaaggtgataaagttacatgtgagatagacaggattggtcagctgacgaattatattgtctgatttttacaagaaagtgaattaggataaagataggaagagaggtagaaaatatgtgtaaaatcgttacaccagttgttacagtttttgatgaaaatgaaaaaccggattatgaagggaataaaaaggtaattgatttcctgattgaaggaggcgttgatggaattcttgtgttgggatcgtccggtgaatttacaggacttacgaaacaggagaaacatgatttcttcaaattctatgcagattatactgcagggcgcacaaagctttatgctggaaccggaagccttaattttgaagatacggtggcgttgtcaaatgaagtgaatgaaatgggctatgaaggagcaatggttatcggaccatgttattatgcactggatcaggaaaagatttttgtatattatgatacgcttgcaaagtcaataaaaggaaatctttatatctataatttcccggcaagaagtggacattccatcgctccggaaaccttgaaaaagctggtggaaaataatgctaatattaaaggtttaaaggactccgtgtcagaaccaaatcatacaaatgaactgatgttggctgtagaaggacatgagtttgagatgttctcaggatttgacgatcagttcctttataatcttacatccggaggagtaggatgcataggagcgctttctaatattgtgcctgaaatctggagtgatcttgtaaaatcaacaaaggaaaaagattttgacagagttatgaagttatcagcactgacacatgaactgatgccactttatgacatggattcaaatttctcgctcttgttcaaaaaactaatgcaacatagaggagtagaagtttcggatcgcgcaattttcccatacaatcagatggatgaagaagtgtataaaaaagcagaaagcttgatggataaggtgattgaggagtatcagaacctgaaataagaagaaacaaagcagacattctgaaatggagaatcatccgttccggtatcagccggggactgggagagattctccatttttatttaatcatgatttattcatttacttcaaaacgccattgctgtctgacacctggatatttctggtgatcgacttcgctcataaacatatcatatggtcttgcacagattttgaatggtgcatacattgcctggtagacaaccagcttttcgcctgtttcggtatgctcggcgaaagccagtacattgtagagatatttggtgctctcttctgatacccattctcttttgaaatggcgcacgatatcgccaacatggatttcatggaggggttctgcgttatttttttcggtattggcagaaagcgtagaagcaggctgtgcttctgggataaccgtactggtttgtgttgaggcagacgattccgggtgggaaattacagacgaagaatctattttattttccggatctgcatccagataaatatactcatctttatcaagagaaaccggtgcgccggtcttgccgatgatatgaacaccaccataccaggtgtcctcgattttaaaagtatctccgatctgatattcggaagaatattcatcgttcttttttatgattttgattttattcatagataatacactcctgtttgtatttgaaaactaatctaattatatgtgcattttccaatttttccaacctaaaaatgggaaaaatcgtgtatactggaaagtactagttgctggccacagatactgtgaacagtaactagtactacggaaaggggaaagataaaatggtaaaaccaattatgagagatctcttttttctgcgccagaaggcagagaaagcaacgaaaggagattttccagttgcaattgatttactggatacattaaaagcgcacgaagatggctgtgtgggaatggcagcaaatatgatcggggtaaataaagcgatcattgcagtcaatatgggatttatgaatgttgcgatgttcaatccgaagattgtaaagagaaacggaaagtatgagacagaagaaggatgcctgtctctggatggtgtaagaaaatgtgtgcgctatcaggaaatcgaagtagaatatgaagatatcaattttaaacggcagagacagaaatacagcggatggacggcgcagattattcagcatgagtgcgatcatctgaaggggattattatttgatggtatcccaaataaaaggtccggcattatgatttcacgttttgtggaaagaaagtcctgattggaacagataaatcggaataatgttgttattacaacagaaatgaaaatccagaaaccgtatacttatccatacaaaaaaagaaggtcattaacagttaaagataaattataaaatcatataagtagatattgagttttataagatattagactagaatattattgaaaggaattgatactttgagtaaatattattctatacacgaattttcaaaaattataggcgtatctgctcagacattacgaaatctttatgggtaaaacgggaaacatcaccaatctcagccatcaattgaggaccaagcgaagcaccaacccctttcatcgccataacaataggatactctgggagtttggatgcagtttcattcataagtgtgcgtagtgattcaacggttgtagaagcactgttaagctggtttacagcctgcttgataataagctttgtaatgtcatccttaggaagtacaggaacaagttcctttgcttttccatagatttcctcagctttggattggctgaagttgtacttcttacgtttgcaccagttttgataatggtcgataaaggcattcagagacattttacggacacagtccacatgccagtatgtagatgcaaaatcaacccatttctggctgccgtcactgcgtgcaggactgtcaaagtaagtattaacaccaggataggtttggtcaaggatgccgataagattatttttcatagccgtcttgtgcttcatgtaaaagccgaactgacggttcatggttttgagctgattgcgtaattcatccataacattatactgtttaagattttgccatttgtcaagagcatatcgggcaatcttaacagaatccgctttatcagatttcactttacgaagagaatcattatcaaagtctttgataagttttgggttaatggcactgacgaaaagatttgcctttgaaagctgatgggcgaggacttcataataacgtcctgtgtgctccatcacgattcgggactccccttcaacagagttgatgagttctacaagtgaatggatatcactggctgtgtgtttgatttcgaaaggtgcggaaacaatttcaccgaaaggtcgcatgatagcaaccatactcttaccttttgaaacatcgatacctactgcgttcataaattgtcactccttaagattattgcaatggataaataccagttttactcattgcctattcaatctactgtggtgtgacgcgaatgcacctatggcgattcaacctgcataaaacgaacgctgcgaatgaggagctggttatcagtctaatttacggacgcgaagtccaagattggaagacgatataccgattgctccatcattatacagcttaagcaacaagatggataatttccttactggctgtaagggatattaaccataaacatattgtagtagaatggagaatacaaaaatgaacttattagaagaatttaaaaaaaatcccggattcgtctaccgaatcgggactgattactattatataggaaaatggatctgcaagccatgcacagacgaagccgttacagactgccatgccatgtatgaaatgtgcatccaggcaaaagaacaggcaaacgcagccctttattttcagaagctgcgtgcctacagtgaatttgccctggacattccatacaatccggcaaagatccttcagtaccagaccgctcttatcgaagcactttccgatgctgatatccagtctcttaccgaccaacttcggcattttcacgatcaagcatcttaatcacatccagaagtgtaggatacacataccggcataatcctctcacttcttcatccggctgtgcaagatccgggatcatcaccggaatcatacccgcagccgaagccgagcggattcctgccggtgcatcttcaagcgcaatactatgtaccggctcggtgccgatcgcctcgcacgctttgaggtaaatttccggatccggctttgcatgtttcaccgaatcgccaaaaaccccgccatcaaaatatttccacaaaccgactttctcaagagatgcctttgcgtggatctctctggaggacgtcgcaagtccgaccttgtatccgtgttccttcgcatagataagaagctcccttgctccctcttttacgccgatcccttctttgtcacaaatgccgtaatacttctcccgtgtctgctcattaaacttgtccatcggaaaatcttcgccatatacacttttaaaatatgcttctctgcggactacattgaatcccagcgtatgataaatatgctccccgatccgtccgtatccaagcttttctcctgcataattccaggatctctgcacaacacgttccgaatcaaggagcagtccgtccatatcaaataccagtgcttctaccttcatcagaattcaattccctttccgagggcatcttttaaatacgtggttacgtcttccagtttttccagaatttcttcacgttcttcccactcttcgccggtcatatctttgctgaccagtgcctgcttgacgtcttttaatttcttgatcaaatcttctgtcataataaatcccccttttcttatcaattactgtttttctataaatttattttaccgatattgtcagcaaatttcaacagttcatccgaaaatgtaaacaaatcttaacattcgccgctataaaaaactcttagctaacttccatttttctacttccattatataacaaatgtgctataataattcagtatgtaaaaaagtgttataatcataaggggattaagaaattggatgacaacaaattagaagcaaaactgctgaagattaaagcgcttgccgaacggggagaaggtggcgagaaagaggccgccatcaaaatgtatcataagcttctgaagaagtatgatattgatgaaaaagcattacaaaaagacaagctcagcaagcactggtttacatatgagacagatatcgaggaaaatcttctggtccagattttttacatggtgaccggagatcccgaatatttccgccggacaagccgtacacgcggaacccagtgcggatgcatatgtaccgattttgagaaaactgaaattcgtttttattttgaattttacaaagatgcactcaatcaggaactggaagcctttttgatggctttcaaattaaaaaatcatctgtttccggatgaaagtgcaagatgctttgttcctgaggaagaggaagagatatcagaaatgctgttaaaagcgcagaaatttgcagaagatattgataagtccaacccggttcgccggattgcatctgccgatctttctgctgatccggatgcactggaatcataggtatatacgccgttcttttgcgatatgcattatagcaaaaaagctgttcttaaaacaggagggtatgactcatattaaatcataccctcctgttttgatttcttgcgctgtatctgtgataaaacttatcttctgtacaatctatagcctgccgataccgccttaacaactcttttccatctgtctgaccacctaggcaagatcccgaagccttgcaatttcttctttatgccccgcatcatccagtggcgtttccagataaaacggcagatcttttaatttcgggtgacgcatgacatttaaaagtgcctccatcccgatctctccgccgccgatcaccgcatgccggtcttttcttgaaccaaatggcatcatactgtcatttaaatgaatcgctctcaaaagctcaagtccaagtactttgtcaaactcttccaacaccccgtccagatcatttacaatatcatatcctgctgcaaacacatgacaggtatccagacagattccgatccgctccggatgtgataccccgtcgcggattgctttcagctcttcaaatctccagccaatctctgttccttttccgctcattgtctcaagcagaaccgtaatattctcttttccggtaatcgcctggtcaagccccgcaatgatattctgaattcctgcttctgcgccaattccggtatggcttcccggatgaaacaccagattctcaatccccagtttgtccatccgcgtcacatcttcccggattaccgtgcaggcgaattcatacacctccggcttcgcactcgccagattcatcgtataaggtgcatgcgccagaatcgctccaaaaccggcctctctcctgatcctctgaaactcctccgcttccttcaccgtcggatccttataattcgatccccgcggattcctgctgaaaatctgcatcgtatctgcattcatcttcaccacattctctgcagtcttcacaatccctttcgcaatcgacatatgtgttcctattaccatatttattagatcgctctcgtatacttcttcagccattctttctcttcatcattcagataaggagacaccttctcatatacagttgcatgataagtattcagacgttccttgtcttctgcattcatgatatccggattgatcgcatccaggtcaaatggcacataagtaatcggttcaaaatacaggaattctccatactcattcttctcgccttcacagacaagcaattcattttccagacgcacaccgtgagatccttcgatgtagattcccggttcatccgtaatgaccatacctggctggaatgcatcagactcaccggctctgtaagtataacggaagcctgccggtccctcgtggatgttcagaagatatccaaccccatgtcctgttccgtgattgaagtccagtcctctgtcccaaaacggctttcttgccagataatcaaagttcattccgcagcagcctttcttgaagatcggacttgcaaggttcaggttactgatcgcaaccagtgtaaaatgatctttcatgatctgtgaaacttctccaaaagcatatgttctggtgatatcagtagatccttcgtagaatcctgctcctgtatccgtcatcaggaaagttccctcatgaagctctacattggtctccggtgaagaagaatagtgtacgatcgcactgtgctccccgaatgcagagatcggtccgaagcttggacggataaatccacccatctcggcacggaactcatccaatttgtcagaagcgctcatctctgtgatcgtctctttgccaacattttctttcagccatttcataaatctgacatgagccacgctatccttgatctcagcgatacggatattttcgacctctgtcggattctttacacatttgaataagatcgccggatttctctcttccactttcttcacattctccggaatgttcttgtaaagtgcaaagttcagtcttcccggatctaccatcaggacttcttctgctgcaaccttcttgatgtcctcataaatatcattgtatgggtgcagaataaccccatctgctgcaagatgtgctttgatctcatcgcttaattttttctcattcacaaaaagatccaccttgtccattctgatcactgcataggtcagaaccaacggaaaatattctacgtcatttccacgaatgttcagtgtccagcagatgtcatccagtgtggtaagaacgtgtgctgtcgcacctgcttctttcattgccgcacgtgtacgtgcaagcttgctctccacagtctctcctgtgtatttctgttccagttcaaataccggctcttctgaaagaatcggacggtcttcccatacttcatcgatcagatcatatgcataaacgacctttccgttcttctcagatgcgatcttctcgtattcttctccttctgttacagaaacaacacgtccatcaaatcctacagtttcgccttctgccagagctgtttccaaatattccccaatcttcggaacgcccggctgtcccatcttcatcagttctactgttgttccctccagctgctttgccgcctggataaagtatcttccgtctgtccacaggcgtgcttctgtcttcgaaaccactgctgttcctgcagatcccgtaaatccggtaatatactctcttgctttaaaatgctcccccacatattcgctctgatgaaaatctgcagtcggaataatataaatatctattcccttttcctgcatttttgcacgcaatttttcaagtctttccggtattgtagacattttaaaaaacctcctttaatttttccattctctgaccattataacccgtaaacttttgaaaagcaacctaagaaaaggagtcggattcggcaagaacatcattttcattcagatcctgtgcactgcctgtaagtccggccgcaagtaccgctacacatccgattatcttcaccttttttgacatctcccatcacctttcgcaaattttcacaaatggtagtctacccgaaaaatttgttctgtctatgggaaaaatgtgatttttcttgaaatcaggactgatgcattgctgcatgctccttttccagttctttaaaaagttccggcacagtccactgactgtttgtgtctgtcagaaccgctttataatcaatacgtttcatacccttctttcgcatcataaataaaatctgatccagatggctgcctgtcactccggcaaataccatcatctcatctgccagctcttcaccctcataaatcctgtctgtctctgacgcttctttcattccggcaagtacaccaaccgtctgaaaatactcttctttttttatcagccgcacccgaatcctgagtgacatacagatcatctgcagctcctgcgcacgcttcttatcttttatattaaataataatactgtttctctcataaatttcctcgactactccgcttttctcaaacggttctttttatgtttattccactctccgattacctcactgacagttgataccgtaacaaacgcactctggtctgtctcatggataaatgcaagaagctttgcatattcactcttttccagaattgtaaccacttctgtctgttcctgattgcccagtcctccgactgccggataaagagtcgcccctctgtgcagctcatgtacaacaaactgctggatctccggatatttctttgacaggatacacaccctcttacggatactgaaaccatcgataaaattatccagaacaatcccataaagataagttcccagaaggctcactaccagtgtctttctgtcgtagacaaggatagacgtcgcagcggtcacaaatcctgcgatcgtaagactctttccaatttcaaaatgcaaatatttatttaaaacttttgcaacaacatcaagcccaccagaagatgcattgacattaaacaaaatcgcctgtccgatgctgatcaccagaatatggcacagcatattgataaacatatcatccgtgagcggcggaacatctggtgtcactgtttcaaaaatacgcagataaaccgggagcattaaagatgtaatgaccgtcttacctccgaattcttttccgacaaacacaatccctatgatcagaagtgctacatttagaatcatcgtcatcgtcgaaaccttcagcggaataaaatttgccagaaccatgacaagtcccgaaatacttcccacaacaaaggaattcggcatcatcagataatacactgatgccgatacaataaacattcctaccgtgatcgttgcatactctttcaatatgttttttgctttgttcttctctttcaattttctttcctctctttcataccggtgcctcttatttccccaaatatgcggcacactatatttcccaacatagcatgttcatcataacatacttctcatcaaacttctacgctatgtttctcattaaaaacatgaaatcttctttccatttatagtagtttcaattataataaaggaagagtgaaatttttaacaatttagagaagagagggttaattatgaatgctgatggaaacgtaatcaaaatcaaacatgacgtactgttcgaagtagcaaagcttgcttttgcaggtgaacttgaagaacagcgtgatcacctcccgctgaagcttattccgggaccgacaccgcagttccgctgctgtatctacaaagagcgtgagatcatccgccagagaatccgcctcgcagaaggcaaagctccgggaccggaagatgatggcaatatcattcaggttatttcttctgcctgcgaagactgtccgatctccagctacacagtaacaatattttttaccttaccagacagaatcctcacacaatcattacgttttcctcgggagagagcattgcgactacaatcccgataaaagaacttatgctctacttgccggaagaagattttctaaatatctcaaagggcgttgttcttcgaaaaaatcaaattgttcatatatccgacgaaggactttatacaatgactgatggtgctgtctttcaaggaagaaaacgtaatctgagtcagcacaaacaaatccgtaaggcacttggtttaaatgtgcagaactattcggagccttcagaagacagctcacttcaattatttaatagctgtagctttctcaatgatatgccacttgctttttgtattattgaatatcatttgcagaaccatatctaactattttagctttcattccatttctcattatcttctctgtccataaccgttcatttttcaaagtacgcctcagttgcggaatcccaggtttacctatagctccgtgaataaaatcctcatattttctatctttcacaatagtgccatctttaaatttaacggtgatatgatttgcatcttttacttcaataatctccgcctcctcattacctctgttttgaatttttttatcccctatatgatttcttgcataacaggaaggcactgctacactacctgtactaaatctttcccatcttgtttttactatttctccattatcaaacttcactttgatatcattactcaaattatattcaatcacttctgccatcatcccgttcttcatttgttttcgtaaatttaatctttgattcttttttgccagacttgtatctttgggatgtgaaatatttcctttaacaaaactttgataacatttatgatatacaatttctccatcctcgaactgtacagtgatatttcgacaactagacattttaatgatttctgcaaccataccattattcatttttttcttttcatataaatgaatcgttgcacgtttattatttgatacatattcctttattgtacgtttatctttctcaaagtttataaacttatcatcctttttgagaacatctctgacaaaacttttcaggcaacattccaatgaagctgacataaatctactatcctctaaaatatagtttcttccactaacaccagaacatcccggttctctaaaacgataaagttttattcccaacttttcaactattttattctttccttcatcatctttatttttagtatgagaatattcaccatcatactcaatcgctattttcagcttatcattatataaatcaagctctttcccttctaaaccaactctgtcagaacgctttgaacgttgtggaattcgaacaaaccccaatgactctaaataaaatcttaataccaattcattttgtgatacatttcctccaggaattgtaggatgtgcaatactaccgatacaaaaatcccgccaggatactcccgttctttttcctccatcttcaaacaaaatatccatatcatgactccccctgtattcaataacctcagcagtcaatccattattcattacctttttctcgccaattcgctcttctctatttcttgaagctttaaaatgtttttcatagttgaagtttccctcaataaagtatctccaattttttaacttcatttctttcccatcacaaaatctgattataaaattttcacaagtactataacttacaacttgtgccctctttccatccctggatgtactctctacccctattctttcacttgcttttgttatgtattttctcatttacacgcctgcattctaatttgataagtgtttctttctaaaatcaaaaaatcctgttctgtacaccaaaacattattttttgacttcctttattatatttttctatataaagaaattcccagaatacttactgctatcacaataagaaattttccaaatcctgatattgtatattctagacctctcatacaaataatctatcttctattaaattgtcttctcttcatcaccgtacatgatgaatcattgtcaaatcatatctgttgtcaatttgatgtcatttagttatttctgttgtcagatgaaagtgttcataagcccttcttaaaatatatccattgttgcagtcaaatgttcaaatgtttcctgttttttctcctctgtcgcttctgcatagatatccagaccgtccatctgatctttcatgagctgtgcttctttttcccaaagcgttacaaggtcttgtgcataaacatatttacgtcttccgagtggatccgtataagtatatacatatctcccgtctgaacgtctctgtgattcacctttccgcaagactctgctccgcagatcttttctgtctgtgccatataaaatcctccttcaaataaaggaaggactatatattattcaggtctgttcaatactttttccagtccctgcaagacaacttctgtcacagtcattttgtatttctttgctattttctttgttttctctacatctttacgtgcatatcccatacacggcacctccttttttgcatgaaagcagctaacctatttttcatagactaactgctcgtgttaaattctatattcagttttattctacaaatccgacagtgaaattcggtcgtatgcgccatttttcttatcttccggatgtggttccagtccgataattgtaatatctttctggtctggtccataaacccagtacattctcattgcgccactggttttattttccagatatgattgccacactttcattccataacgtctggataatggctctatttcatgggtttgaagactcggataacccggatcagccgacaacagctttaaagcctttccccattttttatacaactgttcttccttcttttttatattgccggaacgatatttctcctgcagatctaaccaaagttcctgcatttcaggaattcccattcgtatattaaaattcatctcttattccttttaaaaatctgacaggtcaatagtcggggaaacatcgcctctcttaaagttacttactgcacgatccatatctgccagagttctggctgaaatgctctctggcactgccagttcccgaggttccagaataatgcagccatttccgtattcttttacattgtaatactgataagcagctcctctgagcgtaattctttttttgttatccagatgggcaacataatctttcattacttccattaccaacacctcctacgcaagcatttgtgtgggaaatcccacctcttattattataatacgctttttatattatctgtcaatctacttttacttactcctgatgcttgaaaatattcatacgctggcagacggcaggtggcagatagggtatctatgaaaatctgtatttgcttcaatgactctgccacccatcattcttttaatcgaatactgttttcctgtttttcatttactcgatactccaactcattcttcatccggcttcttacatcacacatggttcttccagaaattccctgttcctttgctttttcatctaattccctgattgaaatttcttttttatcagcaagcagttccctgatcaattttctccctcgctccagctttgtttctgttgcttttccttctttcccatctaaaattttattaaaccgactaaagactccatagtttgtgtgtttgacttactgtttatatctatcttctcctaaatattattctagtcattgcaatataaaattgcttatacagtctctcccttaagagtcctggtattctggataatatacagagcgactgatatgaccatcattatagcgcacaaaccaatcaacagatctgataccataggtgtaatgtggaaccatataatatgcaccgctgcagttccatataataaaaaggttactatctttccatgccagtccgcaccatgtacttttcctgtttttcgtatcacaagacatccactgactgccatatagagttccttacctgccattataacgattagcagaagcatatgcggaaaacgagtaaacagacaaattaacatcgctgcctgtgtcagcttatcagccaccggatcaagtatttttcctaaattactaatcctatggaatcttcttgcgatatatccatcagcaagatccgtaaaaccagacagcaataagatttcaccagctaacagaggatttttctttacacaataactccatataattaccggaatcaggcaaagccgaaaaaaagaaagaagattaggaaccgtaataattctattcaaattttcttcctgattcacttcgctctgcatgtacggtcacctcactttccttttttttagacataaaccaataaaatataacacaaaatgctaaagcaaacacaacaccaaaaacattttgaatcactctaagactaaccgctccttgtagtccataagtctctgcagcaatggttaaagcaccaaatgtgttaaatactgcctgccagccatattgtgctgaaagtcctacaccgattccaccaagaattcctatatatgcatagattgacgaaggaagcagaaaatataatactgtaaaacatataacacctgcaatatttccgacaatccttttacggactctgtagtgcatatcttccataaatggcaaaatcgcggacatggccgcaataccagcccacattgcacgtggcatattacaaagttctgcaatgcaaaggacaatcggtacgcataaaatctgacatatctgccattttgttctggaagaagtgatatcaaattcttgtatcagatctttcagatttcttttataagttctgtttttatgatttcgataaaatacgaagcaggtaagtgctgcacctaaagccattccgactaatcgcatctgatagctttttcccgtaacatcataaccatatagcagcagatacccaagaaccaatgtagattgattaaacatgaatggattatggcatccgaacagaatcaacacagccagtgccgcaatatttaacagcattcccaataccggtgaaaactgatttgctaaatgcggacatacagtcataattacaaagaacaaagccaaaagcatcgtagattgtccggtgtggatccccagatccgcatttctaaacaccatgagacataataagaccactacacctacaatgctgttctcatttccaaataggatgctgaaaatactaacaaagaaaaaacaaaatgccaatgtaacagctatcttcaccagatatacccacatatgatataatttttcttttagtgtttcactctttttcaacaggtttttagaacctgcctgatttaactgcaactcctgataaaatgtcatataaattctcccatcttctaatttatcttaaaactatataatctcatctttctgctttggcagctctataacaaatctgcatccaccatattcacggttttctgctttgattgttcctccggcactatctacaatccgttttacaagtgcaagacctaggccatttccttctgctttatgagatccatctacctgatagaacttgtcaaatattctggattttacatcatcctctattcctggtccttcatcttccagaatgaacttaacagaatcctgttcttgtttcagaaacatcataattgtcccctttgaagggctgaacttaatcgcattatccaaaagatttatccagatatgcataaaaagtccttcattcccagtatatttaacttcctccaattctacctggaaaccaatttctttttctgtccattttgtttccaatgaaagaaatgcctggcggatctgttcatccaggcgatattctgtttttttcattggtatattctgattctctaacttggataacagcaaaatattaccaaccaatccggaaagtctttgggtgttaaataagattttttctacatattcctcttgatccggagacagttcttctccctgaagcagcattgtatatccttcaatggcattaatcggggtcttaaactcatgagaaacattagatacaaaatccatctgcagcacctctgttgcacgaagttcttttgtcataacgttaaaactttgataagattctccaacttctgctatacggctgttcgtttccaaatgctgttcaaaatctccctgagaaacttccttcattgctttactaagtctggtaattggttccagtaactttgcattgataaaggaagtgatcagccctgcaatcaatgtattgaaaatcaaaagccagccaagcacagatatgctgcccggcagattaaaaaaatgattcaaaaaagcaaataataaagcagatatgactgttgaaaatacaagtgccagccagattgcaccagtcagacaggatcggatccgcaatcctttttttttcctttgttccattattttttcaccaccttgtatccaattccacgcattgttacgatttcaaaatccggattatctttaaaacgctctctgagtcttcctatatgtacctctattgtatgtggatctgcctccgtctcgtatccccatacttcatccatcaactgttgttttgtaaatgttctgcctggcgaagctgcaagcttatataaaagcaggaattgttttttaggtaaaacaagactttccttatcagttgtaaccgtcattgcatcataatcaaactccgttgaaccaatcacaattttgtgttcattcaatatctgtgcacggcgaagcagtgctccgactcttaaaaccatttcattcacatttaccggttttaccatataatcatcacttcccgaaaaaaaaccctgacgcatatcatcaaaggaacctttcgcagtgatcataagcactggtatctgatatcctgctgaacgaagttctgacaccagttcatagccatccataaccggcatcataatatcagaaatgatcagatcaatatattccttatccaatacttctaatgcctgtgctccatccgatgcacttttgacttgatatccattcttctcaagcactttttggaatagctggcttaattctttatcatcttctacaatcaatatttgaaacacgttttccttcctccttattaaaacagataccttgcccatccaagcagatgctgtaccaaaaatatttttctctgacgtttctttattaagggcttatatgtaacacagattaccgaggacggcgaccttgccgtattatctggaagtaaccagttttccgtatcagacaaggttatccgtggcggtgtcaaaattcagaaacgagatttagaaacgggcgatacaaagccacaaggaagtgccactctgaaagatactgtctttgacatcatttccttaaatgataatgcagtattggttgagggcaagctatataagaaaaatgaagtcgtaaaaactattcgtacagatattgagggtatcgcttctacttcttctgacctcttaccttatggaaaattccgtattgttgagcgtgaagctcccgacggttacttaactgacggtgcaaaaccgattgactttacaatcacagaaaatggaaaaatcgtggacttaaccgacgaagctcattctatctataatcagattaagcgtggagatattgagggcgtaaaaattggtgcaggcacacacaagcgtcttgctgatgttccgtttcggatcacaagcaagacaacgggcgaaaatcatgtattggtaactgatgataacgggcaattctccacttctgctgattgggcttctcataagcacaatacaaacgcaggaaagaccagcgaggacggtgtgtggtttggaacttctgaaccagacgacagcaagggtgcaatgccttatgatacctacatcattgaagaaatgcgttgcgacagtaacaaaggctttgaacttatcccaccttttgaaatcgtggtatcaagaaataatcttgtggttgatttagggacgctgactgatgaatacgaaaaagaaatctctatccataccacagcgaccagcaagaacggcgaaaagactatccttgctggaaaagaggtaacaatcgttgatactgtcaaattggacagacttacaaaaggcacaaaatatcagctcaaaggctggcagatgttaaaggaagaaaatgccgagcttatcattgacggaaaacgtgtgaaaaatgactatacctttgtcgctgatgaggaagaaatgaaagtagaaatttcttatacattcaatgcgtctgctttaggtggcaaaaaccttgttacctttgaagaattgtatgatttcagcaatccagacgaacccgtgaaagttgcagaacacaaagacattgaggacgacgggcagacggtacttatcacagagcgtatggaattaaaaggacgtatcagagaagcacttatcaaaatgattttggactttgatattcctttagaaaccgaagaataacaagcagtaatcgcagagcatgatttgtttactcccctctttcctgctctgcccctgcttttacatgaaagcaacacgctttcgccacagctctttgacaactgaataaagcagacagatacgtttgtgagatagcgagccacggggactgtacgccacgaccttttcaaaaagaaagcgagcgacccacgcagtgatccgagagcgactgttggaaaagtcgttttgccacgacctatcctcacaggataatgatacgtccgcatggtgcggttctgcccacaagaatgggaatagttgagatactaatggagctttccaaagccgtctgcctgcttgtaaaaaatgacacacagtaaagggggtgcatagattatgaacaatactgatgtgcctatctgggaaaaatatacgctgacgattgaagaagcgtccaaatacttccgcattggtgaaaagaaattgcgtaaattagccgaagaaaatattgacgctggctgggttatcgtgaacggtaaccgtattcagattaagcgaaaacaatttgaaaaaatcatagatacattggacgaaatctaatgtcattgagccgtgaatatggtataataagatatagcgtatcacggctcattccatgacggaaaggagctttacactatgtctaatgtgaaacgaaaagacagtaaaaatcgcaatttgcgtaatggagagagccagcgaaaagacggaagatacgtttataaatataccgatatatacggaaagccacaatttatctattcttggaaacttgtaccgacagacaagacacctgctggaaaacgtgatgatatttcattgagggaaaaagaagcacaaattaaaaaagaccttaacgacggtatcgacatagcaggcggtaaaatgacagtctgccagctctacgacaagaagaacagccaaagaaagaacatcaaaagggctactgaaaaaggacgacagtatcttatgaacgctctgaaaaatgacccattgggtatgagggcgattgatactgttaagcagtcggacgcgaaagaatgggctatcagaatgagtgaaaaaggatatgcctataaaaccattgataactataagcgttccttgaaagcgtcattttacatggcgatacaagacgactgtatcagaaagaacccgtttgaatttaagctaagtgatgttctggaagatgatacagaacagaaagttatccttacaccagagcaggaagaacgcctgcttgcctttatggaaaaggacaagatttacagcaagtattatgatgaggttgtgcttctgctggaaacgggacttcgtatttctgaattttgcggactgacgacgcatattgatatgcagaacagaatactcaatatagaccaccagctattgaaagacaacgaaatcggctactatattgaaacgccaaagaccaaaaacggaaaacgggaacttccattgacagaacgggcttatcaagcaatccaaagaatactaaagaacagaggaaaggcacaaccgctgattgtaggtggttacagcaatttcctattcttaaaccgtgagggcttacctaaagttgcaggaaactatgagggcatggtacgagggctgattaagaagtataacaaatatcacacggacaagttaccgaacatcacaccacatggtcgagttataataaggacaagttagaaaactccagtaaatacaaggggttgcactaatttagtccttatttttaactccctgaaaaagggaaaaataagacagcgctgtcattccagaatatgaattattacagatccagactggaaatggatttgtgtaagacaagagtaaaaacaacagaattattgtaattataggactgaattagctcgcacggaatatagattccggttgtctaattcagtcctctttttgattgacgacgatgaaaggtgatgaaaaatggctagaattatttctattgtaaaccaaaaagggggaactggaaagtccgcatgtacagctaatttagcagtaggattagcacaaaagaatatgaaagtgttaatcgttgatgccgatccacagtctgatgtatctgcaggatttggatatcgtgattgtgatgaaagtaatgaaacacttacagctcttatggatacagtaatgaaagatgaagatattccttcagactgttatatcaggcatcaggcagaaggaatagacattatctgttctaacattggactggcaggtacggaagtacagttggtaaatgcaatgagcagggaatatgtattgaaacagattttatatggtatcaaggatcaatatgatgcaattatcattgattgtatgccatcattgggaatgatcacaatcaatgcactggctgcatcagatgaagtactaattccggttgaagcgtcttacctgccaatcaaaggattgcagcagttattaaaaacaatcggtaaggtccgtaagcaaatcaatccgaagctgcaagtcggtggaattctgtttacgatggtcgatgctcatacgaatgatgccaggaataatatggaacttctcagaaatgtatatggaagtcaaattcatattttcgataattatattccattttctgtaagaatgaaggaagcagtcagagaaggacagagtattttcttttatgatccgaaaggcaaagctacagaagcttatcggagagtgacggaggaggtgctgaaagatgccatctaaaaaaagagcaactcccgtttccttacagccgcttgatgcattgtttggaacaaacgaagagacaaccaatggaattagtgagatagcaataggaagtcttcatccatttacgaatcacccgtttcaagtaagagatgataagaaaatggaagaattagcagaaagtattacacaatatggcgtgttggttcctggtattgtgcgtttgagagagtccggtggttatgagctggtagctggtcatcggcgaaaacgagcatgtgaacttgctggactagagaaaatgccggttatcatcaaagatcttacggatgatgaagcgacggtaattatggtagattccaacattcaacgagaagagctgctgatcagcgaaaaagcatttgcttataaaatgaaatatgaggcgttaaagcgtcagggaaaacgctctgatttaacttcttgccaagttggcaagaagttggcggcagaagaagtcagtcagaatacaggagatagttccagacagattcttcgatatattcatctgacagagttaatagcaaagctattagaattggcagacgagaaaaagcttccctttaacactgaaaagaatcatactgataagagtaagggcaatactcccgctttggaagaaaaattcagtctaaatgggagatttaaaaatgttgttctgtcggaagcagaactgcaggagttgatgacgctatttccatgggattaccagaaacggatagatcatctttctgtttatatgaaatccagtggaaaagagtatcagaatcattttgcaacaatctgtctttggtcagaacgagatggagccagggcaggaagggataaatatgaatttcaggaaggagaaagcctgtgatggaaaataaagtaacagcagattatctggatgaagagggatgtcttcattgtggtatctgtggaaaaagaaaacagatgaaagttagtctgatgggatttgagcatgtagtgtcctgtttgtgtgaatgcgaggtaaaagccagacaggaacttgatgagaagatgcagcgggaagaagcacagcggcagctttatcagagaaaatccatcggacttcgggaaagaagattttgggaatggaaatttgaaaatgacaatggaagcaatcagaagatactaattgccaggcagtatgtagaaaactggacagatatgaagagaaaaaatgtaggattgcttttgatgggaccagttggaactgggaaaagtttctttgcaggctgtattgcaaatgcacttttggaacagggagaacgtgtcatgatgacgaatttttccaggattttaaatgaaatgaccagctatcaggcagataagaaccagattatacaaaatcttgtggattatccgctgctgattattgatgatttaggaatagaacgaaattctgagtttgctttggagcaggtctataatgtgatagacagccgctattgtaaaatgcttccgctgatcgtaacaacgaatctgggactgaatgaaatgaaatccacagatttagatactgcccatcagcgtatttatagcagaatacttgaaatgtgtgttcccatctattgtggtggagaagataagagaaaagaagaagggacagaaaaactcgtacaggtacagagcctgattaccggttaatctgtccttttttattgaaagggggtgattgccatgattacagatctggacagcagttaaatcgctgaaaggagggaaaagtcatgcaggaagaggtaactcagaaaacggtcacgttctgtattcggactaccaaaatcacagcagacctgttgagaaaggttcttgctgcgtatctgcggcatcataagcagaaatcggtagagaagaaagcacagaaaaatcagccgaaacagggaaaggtcacggtaaaagagctggcaaagcagaatgccgggatggtcaatatcgagatcacgaacaaaaatatcaagtcctttgaacgctatgccagaaaatatggaattaactatgctctgaaaaaggacaagagcaaagagccgccagtttatctggtatttttcaaaggacgtgatcaggatgccctcaatgctgctttccgtgagttttcccagaaacagattcaaaaagcgaataaaccttcgattcacaagcgtctggcagcttaccgggcaatgatgccaaagaagacgaaggacaaagtaaagaaccggcatcaggagcagagtcgatgaagaaacagatcggcaaacctctgatgcagaagtggaagaataagatcgggggtaagctgtccgccctggataaaaagaaactggttcttaccaatctcccatatgctctggctgcgttctatgcagaccgggcattttttctttaccggaatagtccgggagaagatatggggaacaaactcttatatgctatggaacacgcagatcggatttttgctggttttgtgttaagcaataactggaaagatctgctggcagggattacggttgcagtcgttttgaaagtgctggtttggcagaaacagtcagatgcaaagaaattacggaaaggcatcgagtatggttcagccagatggggaaccgcagaggatatcaagccttatatgtcggaagatccatggatgaacattccattgacagcaacagaagcactgaccatggagagcagaccgaagcagccgaagtatgcaagaaataaaaatatagtggtcatcggcggcagtggttccggtaagacacgttttttcgtaaaaccatcggtcatgcagatgaactgttccatggtcattacagatccgaaaggtactttgattgaagagtgcgggaagatgttagcaaagggaccacctaagaaagataagaatggaaatatcatgaaagataaatctggaaaagtggtacatgagccatatgtgattaaggttctgaataccatcaatttttccaagtcccttcattacaatccatttgcttatatacggtctgaaaaagatatcctgaagctggttacaacaatcattgttaataccaaaggcgaaggggaaaaagcttccgaagatttttgggtgagtgcgactcgttcgcaggcggtaaaaagtctgcgcacgggcaacggttttccgttgttcggagaactgatagtttgctcctgtctttgataccaggagtattgacaacatatggaaaactatacatttttatctgtgatattctacctgatctctccggataacatccgatactgtagaggcctgattgtcaatatgacatcccatgagctcacatgcctcttcaacctctccacccgaaatcagtgcgatcagcttatcatgttcttccaggagctgtggataacattccttctgcttcagatattctacgcggaaccggtacatctgttcccgcaggttattcagcagcgtgatcagtctctggttattggttgcggcaaagataatatcatggaattttacatctgcttcagcgatcttcgtcacatcaccactctttaagactttacggaaatcttcagctgccatcttcatttcttcaacctgctccggcgtgatccgttcacacgcaagctgtacggaaagctcttccagtgcctttctgacttccagtacatcctgcatattcttctctgtgatctgtgccacttctgccccttttcgcggaatcatcagaaccagaccttccagctccagtttacggattgcttcacggatcggggtgcggcttactccaagcttgttggcaagctggatctccatcagccgttctcccggcttcagttctcctcttaaaattgccttccggagtgtattgaacacaacatctctcaacggcaggtattcattcatatttacttcaaaatccatatccattcttatctcctcctgacgttatgcacatttgcaagataaatctgttttgccaaattctgtgcttttacttttgtaaatgcttccttcgctgtcctgcgatccctgaaaatcccaaatacagtcggaccgcttccgctcatcatcgccccaagagcacctgcttccatcatacattctttgatctgtgcaatgaccggatatgcttcaaccgtaaccttttccagcacattacccatggatgctgccacttgctcaagatcctggttcttcaatccgtccaggataccatctatatccggatgctccttgatttcacaggaatccagcttttcataaaccatctttgtcgatacactgatcggcggcttggcgatcagaatctgacatttcggcatcggaggaagcggcgtcagtttttccccgattccttctgctagtaccgttccgcgcataatgcagtaaggaacatccgccccaagcttcacgcctctctccatcagctctttttgagaaagtcccaaccggaacatctggttcatcccgtaaagcactgccgcagcattggaacttccgcctgccattcccgctgcaaccggtatatgcttgtccagatggattctgactccgtctttaatatcaaattcatcgatcagaagctttgccgctttccatgcaatattgtcctcatcattcggcagataaaaaagatttgaatcgatctcgatacctggggccgacttcttttgcagcgtcacattatcgtacagatatagcgtctgcatgaccatgcgcacatcgtgataaccattctcccgccgccccagcacatcaagtccaagattgatcttcccaagtgcttttaactccagtttatccatgcgtgtatctccttattgtattttttcgacctttttttgtatcttgtatacatcatttcattactatagtatactcaaactctcccgaaaaatcaatattttatcacccgttttcaattcttttgataataattcattattaagcagaatactttcttccgtggttgaatatttctttgccaggctccacagatcatctccgtcttttacgatatatcccacaattccaggctggttcatccgctcttctttttcataatccacaagtgcagcctctgtcaccatctgtattttttccgcttttcgcatgaagcttctgaacgccacgaccactttgatctctacttcatcatttccggcaagatctaccgcaagctgctccactgcatatgtgacgtcatatttcatatcgctgcttccttcccggcattcaagcattgccgagaacggaaccatccccttccacacaccaaatggtacttcatcatttgcctttacatacaaaaagctgacatggagaatcccctctgccagaattccgccatcctgcacttccattttttctatctgcaggtctgcgctgctgtggcacacctgaaggatctcatctttcagctccggcagacttaatcgttctgtgatcttactttttgaatgattctgcatcagaagctcctcaacaacaacttcttctgtctccaaaacacattttttatcaagggaatacgcatcctctaaaagctccagcttttcttccccatagacaaaaagacgaacctgaagtgccgcttcaatgccaagtgcacgcatctcaccgtcctcatccatccgcacttccacactgatatcatccagccggtcatagacatgatgatacataccttcttctgcgccggcacactcgatccgcccctcataaggaaccgtctgctccacccagtctgtcttgccctcctgggattcatagagaacaaagatctgtaattctccatttatcatcatagcatcctgcacaagtctggtatccattttccgggagcttacctctgtccacaagagcgttccgatattctctttggtccccggtatcttaatctcctctttgatcctgtaaatgtctctctttgcggtaaacagctgcagcagctccaccggacattttttcagatagattccctcttccccatccacatcaagtgtcacctgtttttctgtgatctgctctgtatgtaccgtcatttccgcaagcgcttttaccgcaagctttctcgaatggatcagtgataccccacattccacccgctgaacttgcacaatgtcttcgccttctccgttctcttcctccatgtagaccatttcctcaaacggaatcattccctccaaagctccgggacgcggatctcccgaatctgtcacatacaaaactttaaaattcagttttcccgtcacacggagataattttccactcttcttgtctcttcaatccgcagacttccctcaccggaaagcactcttcccacgtcacttttcgcatctggtacattataatccccaccgatcataaactgatccgtcactgttttgcccatctgattcatgcgtacctgttttcttatcagttccatagtcagcctcctactcaaatatcaccggtttttcgcttttttccatttccaggacaacatatgggtattgggaaaatccatcttcccgcatacagatatttcccatctcctccccatctttttctgtctcgtcacttcccggtcccagaagtgttgtctgtacacagatcacatctttttcttccgtacagccatcaacccggatcgcatatccctccatttcctgtctcccatacccctgtccgacatacagccggtctccttgcacatacataatctgaaatggggtttcttccatcccggcaatgcgttcggtcatttccgccggaacttttttctcatccacaatggaatattccagcatttctccacccgcttcctctttttccatgacctgacagccgccaaggaaaatcagcatccagatcacccctgtcacacagcattttattctcataattattcacaaacttttccatttttttgtctctttattatcatattatcttccttgtattttcatgcatcgaatagtataatcgaagaaaagtatgttactttatacaatgaaagagaggattttggggtaatgatacgatttatctgtatcgcagtctttttaattctttacctgatcctgtccattccggttttgctggtggaatggatcattggtaaattcaatcgcagagccaaagatatcagttctctgcgcatcgttcagtggggctttaaagtgattcttaagatgaccggtgtcacgacaaccgtgatcggtgaagaaaatgttccggatgaaccggtactctttatcggcaaccaccgcagttattttgatattctccttacttacagccggtgcaggcgtctgaccggttatgttgccaaaaaagaaatggaaaagattccgcttctttccacatggatgaagaatctgtactgtctcttccttgacagagacaatatgagagaaggtctgaagacgatccttcaggcaattgattatgtaaaaaatggcatttccatctgcattttcccggaaggaacccgcaacaatggcgaagagctttctatgcttccattccgtgacggtgcacttaagattgccgaaaagaccgggtgtgcgatcattccgatcagcatgaacaatactgctgacatttttgaagcacatttcccacgtgtaaaaaaagtacatgtcgtcatcgaatacggcaaaccaatctatccaaaagaactggataaagagacaagaaaacatcttggaatctattgtcatgatcttattcaggacacaattaagaaaaacgccagtctgatctaaacctataacagaaaagaggtacgattatgcattctaaaaatttaacattacttacagacttatacgaactgactatgatgcagggttattacgataagcaggacaatcctaccgtaatttttgatgtattttaccgttccaacccattttcttccggttatgcaatcgcagccggacttgaacaggttattgagtacgtgaaaaatctgaacttcagctatgatgatgtggattaccttcgcagtctccacattttttctgaagattttcttcagtatctgagcggctatcactttaccggaagcatttacgcaattccggaaggaagcctgatcttcccaaaggagccgatcctcaaagtcgttgccccgatcatggaagctcagcttgtggaaaccgcaatcctgaacattctgaaccaccagtgtctgattgcgaccaagtcttcccgtatcgtatacgctgccagtgataccggtgttatggaattcgggcttcgccgtgcccagggaccggatgccggattatacggcgcacgtgctgccgtgatcgccggctgcgtgggaacctcctgcgtacttaccggcaagctttttgacgttccggttatgggaacccatgcacacagctggatcatgagtttcccggatgaatataccgcatttaaagcctatgcagatctttatcctgaaggatgtacccttcttgtcgatacttacgacaccttaaaatccggtgtgccgaatgcgatccgtgtcttccaggagatgaaagatgccggcatcagcccgagaaagcttggtatccgtcttgacagcggcgatcttgcctacctgtccaaaaaagcacgcaaaatgctggatgaggccggctttgaagaagcaacgatctgcgcatccaacgaccttgatgaatatctgatccacgacctcaagatgcagggcgcagcgatcgattcatggggtgtcggaaccaatctgatcacctccaaagactgtccttcattcggtggtgtatataagctcgctgccatccagaataagaatggtgagttcgaacctaaaatcaaactttctgagaacacagaaaagatcaccaatccgggcaacaagacggtttaccgtatttacgaaaaagaaaccggcaagatgaaagctgattatatctgctttgtagacgaagaaatcaatccggaggaagatcttctcctctttgatccaagcgagacatggaaaaagacaaaaatgaaagccggaacctataccgtccgcgaaatgatgcagccaatcttcatcaacggtgaatgtgtctacacttccccgtctgtcaaagagattgccgcttactgccgtcaggaaaaagataccttgtgggatgaatccaaacgactcttcaatcctcaccagatgtatatcgatctgtctccaagactttatgaagtaaagaaacagcttcttgaccgcatgagtgctgatgactaggttacaatttgaaaagaggtattaccgatgaaaaatatgacattaaaaaatataaccgctgcctgccatggaaccttccatggcgacagcagttttcttgaaaaagagattaccggcgttgcaatcgacagccggaaagcagcaccgggatttctttttgttccactcaaaggagcccgtgtagacggccacacctttatcccacaggttatggaacagggtgcacttgctactcttacagaagaagatccttcttcccttacctgtccctgcattcatgtagaatcctgcgaaaaagcacttcgtgatatcgcagcgttttaccgcatgcagcttgacatcaaggttgtcggcatcaccggaagtgttggcaagaccagcaccaaagagacgattgcctctgtcctttcccggaaatacaatgttcttaagacagagggaaactttaacaacggaatcggacttccgcttaccatcttcaatcttaccgaagaacatgaagtcgctgtcctggagatgggaattgaccatttcggagagatgcatgaacttgcatccatcagccagccggatatctgtgtaatcaccaacatcggtcttgcacacatggaaaatctcggaagccgcgacggaatcttaaaagccaaaaccgaagtttttgatcatctgcgtccaaatgcttctgtcatcttaaacggagatgacgacaaactttccacagtcgcagaggtacaagggaaaaagcctgttttcttcggtctttcagaccagctggatgcctatgcagacggaatcgtaagtcagggacttcgcggaactgacgctgtactccaccttccacttggtgaaatcaacgtacatatcccggtacctggaaatcacatggtttataatgctctcgccggagcatgtgtcggcatgaagcttggacttactctggaggaaatccagaccgggatctcttccctgaagacgattgccggacgtaccaatctgatcgacacaggatctcttttgatcatcgatgattgctacaacgctaatccggtttccatgaaatcttctcggaaagtctgcccttttttagtcagaaaacaaaatatttttttctcatttaattattgacatttattagctggactcggaaaacctttgttttcttacctatattatacacaagctaagagaaaaatgctattgtaaatatacacaaaaatagtaataccgtatcagataattcccacaaatgtatcatatctgtgtagtaacagttcatacctgttcattttctgaatcagaatcttcattgtatatgtactttaaatatggctcatactcaaatttttctatattttttaaatcatcaataaaatcaaaaaatatagagtgtgataatattttaattgaatccataatttacttacttgttagcttatcattttttattcaaatagtctatatttttcaagtcgccaatcgcttgcgatcttacattaaggcttacgccacccataagagggttagtctctgagcgtcctccatatcatatgatttaggaggttcgttgcgtctgggagacttgcactcccggttatccctgatttaattgtttttatggtttctacccatgtagggctgtgagttttaaactctaccgcattcacgcttaccgtttccagttacgttgtagccaattaaattttatggggactccccgcaattaaatagatttatacttagcgtgaaattcaccaagtcttataatcactaattttatccttcaaatcagaatcagtgattgtttcaatgtcaatacgtccatcacgtactttcgaagcccagtcttcagacagacctacagaattagcctgttggatatatctgtcatatgcctgttgctgtacattcaattcgttcgatacttgtgaaagctccgatgcgagagcttcattacgttttgaccagttcttatatgtactggatgcagttttgtcaacaaggtcgatatttcgtttgatccgatctaattctgtctcaatccagtccagagtttctttcgtttcttcggctttagatgatgtatctgaattagtgtttgaggtattggtattgttatttgatggagaagaattgtacgatgatgaagcggaagaattgaaagaagatccagtataattatttttatttgatgaactagcaccagagccaggtaaacgaccacctgatgcataagcagtaccttgtaaaaaagctgttgtgttagtcaaaccaggtaatgatggattacctttcgcccttgaatttgttttaccttttgtaagtagttcttttgattgtcttgaattaaagactaccgatccagcgggtatagcagcaaattcagcaccttgatttccaacagtataccatctgtttgaatttggtggtacgacaatttccggacctttttcgcctgtcagagcaacttcatcttttccggttctccatgaactctttagaaatgaatcatcttgtaaagtacccatggcaagagcacgagctgagagtttcggaattggagatacattatctactgttccatcaatatgagcagtgccgtataagtcccctttaccagtaaaaaatcttactactttctggaatattgtaggtaaattagatgacacaccagaattgtccgctgttcttacaactgactgtccaacagaaaatggattagaggaaataccagaattgtctggttctctaattacaacctgtttcgcatcaggaacaacttgaggaacatcgcctacggtataactaatagtaccatctgcattttttacttgttgaaggtaaacctgtactccattatctacaccaatataactaatagtaccatcttgttctctaaccgctgcaactccggcagaaacattatctacgtttgctgtaaaatataaggtttgtccttcttttaaagtattaagttgctgttgaatttcatctgtagaggcatcgacattcataaaaatagttttcccatcatcggaaacaatcccatttattttatcttccgcttttgatgtatctgcatctacattcacttttggatttgactgttcagccttttgatttacatcatcaactgcttcttttgcttcagatgtatctgctttataaacgatatttccagtctcgtcagtttcttgctttaattcttgtttactattttcatcaatctgaaaataataatgaatctttccatcttcatctttgtaagcctgaatatctttttgaacgccatcaaagttaccagtgaaatagatagtctcattctttccaagattattctctagccaagaagtatctttcccgtcaaattcggcagtgtattttattttaccatcttttgtagtaattttatttacatctgtttcaactccaccaatatctgctttatatgtgattgttccgtcttcgtttttaattgccttgacaacagattctgcatcgtctacagttgcattgaaggtaattgattcaccatttttcagtttatctaattctgcctgaagttctttctcgttctttatttcaacgtcgacatttatttttgcagcatcaccaaacagattctttaaatcatctgctgttaattttccggctgttataatatcctggaatgcttttgttgcttcagcagtttttaaataatctttccagtcaagatttcctccatctttttgaaatttaagataattctcttcgagtgtttgtatcgcagctacctgcgcatttatatttgctctttcttcttcggaagcaccattcatctgactacgaagttctttaactttatcatcagaaaattttacacccttattgttgtcagcagataatccggtttcatcaagaagcattttaattgcttgcttttgcgcaacagtaacagcagcccagtcagaattatctccagttgcttcggcagtatcctgtaactcctgaattttttgttctattgttgaaagatcatattcaaatttaattttgacaatttgatcatctgacaattcatcaaggttttctgaataatgctcatattcactattccatccttcaagaagttttccaatttaatcctcttctcaaaggcaggtgatagtatgaaaacatttaataaaattaaagaatttttctcacacaaaaacaaacaagaatctctgaattataaaacatacgaggattataaaaaagagattcttgaaaacaaaaacgattttgatgcggctatcgtgtcaatgaacaggttgtaaaatgtgtaaacaatataattctaatttggaaccatttgttaatttcactggggaagaagctattattgaatcaatctcaaatgaaaatgtaacaaaattctttaataattctacagaatacatttatagaaaaatcacttttgccagccaaacaatttccattgaagagaattaaagtgttttcttgcatcatcatatgttttcatttcttttagatcattatataacattacaaaatctgggaatgatctttttaaattattagagatcaaatttactatgtcaaaattgctattaaactgttcgcatatatttaattcagcacaataccaaaatatatcattatatgtaattatatttttgttatttatcttttcatagtaatattttatcctttcattggtagagtaatcatttataatgtcttgttctgtataatcatcacaaaataatgtaagtacttttctaccatgatacaacgaaaataattttgcatgaaattctgaccataaagaaaaagccggacttatttcaatattgaagatatcattccaatcattattacaatagtctattaaaaacatgttataatcaagaaaatgaattaattcgtgaataattgttattcccatagaatctttgttttctaaaaatttatttttatttattaaaataatattatctgatgttgggataaaacaaccgttcacgtttttgtctatcaaatcgcctggattataatattttgcacgagtattttgaatgtcatttgtgaataaaatattcacattatttatattatcaaatcccatgactttcatgtaatttttgcatatttttgcaaatgcgttatttatttctttatccgaaaacattttattcataacacttttctaaaaataacttttacaattattacaataccattgtttaccaacttttttagatagcaaaccgaaacttaatacggatgctactctaccagtggttgaaatcttttttgtattggttgatttgcagtatgggcaagtaacatgtgcagatgattgctgttgggtggtttgtaaattcaattctttattttacaaattgatttaattttgtttgagtttggtctataattttatttattacagtaggattagttataatactttcaattacttttgatgatatgaaactcagcgcgtgcattgacataagtccaagttttgacgctccttcttttgtggcatcccatacatttttaggtcgaatattatttaaaaaatcatgtccaatgtatgttatatcattcacataagcatttacaatatatccatctctatcagatgcgatattaactaaactaataaaacgtgcttcgtataatttttcaatggaatagttcacgtcttctttactataagtagttgaaaagtaatctggtattgtacatatttgaatctctttatgttgtaatgcaccgacataatctgtatatcctaagttttcttctaaatataataatacatctcttacgcaatccggatttaatttcatattatttctcctttatagaaagttggtgattttatgtttaaaaattatttagaggacaaaatattcgcaaatattcttgaaaagcattggaaagatgtttatatttcaaataaaatacataatatcctgctttctgaaaatgtttccaaagctgaatgcaaaaatattcttgaatatgtttggaataattatccagacaaaattgttgattaattagaatttatatccacaatccttacagtgcatttgttttttagcatcgttgctgaataaaccaaataacatagaccctttgatcttcttcccgacagaaatcttttctatattagtagaattacatactggacaatgcggaacgtttgatgactgtttggtggattgatgtgcggaattctcacgttttccattttcaagaatcacattcaattcttgtttggatgttctatagtcatagccacatacgttacatttattttcaactatatgatcacgtgtatttattccacaaattggacatttttcaggtaaagagatattatcttctatattatttttagtaatttctttaattttttcagttggacaaccacattctggacaacttattgcaaattcagaaaacatttttccacattctgggcactttattagagacatattcttcctccaaatcaaacaaatattttctttaagtataacataatttgtgaattatgccaatatttcttattatgcaatgcagtttaaagacttaggaaaattatttggtagttttgatgaattaaaattcaatcatgcaaataatgctttatctttttcagaattagatggtgttgatcaaaagaccattagtagtttatttaaaatagattcttctggtgtaagtgaatttactatggctcaaactcaagcaaaaacaagttcaatggggctaacaacggcattaaccaacgagttagtagctttatctaatgatgcagattttacagcgaaagcaagagccggaaaaattacttggggacaagcattaaaagatacaaccataaaaacagaagatctaggagatgcattactctcaagcaataaagtatcaaaagaagcaaaagattgtttaaataatattgggaaaactgctggcaaatcaagcgaaaattttaaaattgctgttgataatattattcaaggaaatgctggtttcgagagcattgctgatacgacagttgatgtcggagaaaaagtttccaaatcaacaggcatgtttgaatcagcaggaaatgtacttaaaggtgtcttcgcaaccattaaaggatttattccaattctggctgtcgttggtactgcatttgcggcatacaagctttatgatgcacttacagtatcttacagtgaagcaagagataatctgactaatgctgcttctgattatgaacaaactacaagcgaattagaatcactcaattcagaactgaaaacaactaaaagtcgtatttctgaattaaaagaattacaatctactggaaagattacttttgcagaagaaaatgaattagcaaaacttgaaaaagaaaatgcttctcttgaacgtcagattaaaataaaagaaagattggctcagattgaggcaaaagagcaagctgatgcggcaaaaaaaactctcggttacaaatcagaaaccacatatgattggaatgatgatggttcattaaaaacaaatattgatggtaagccaatattctcttgaactgtcgagctgtttaagagtcattggttttatgagaagttttttttcaacgcattctcggaccattaaatcattccccgttgttacacatacaaaatctgaagtataattgccttctaaaccttccatcaaaacattgcatcgtatttctcggatgtgttcattgtcctgtagtttatacagatactttttctgaagttcactgtacattctgcatacgtccttagatttggaaacagataatttttcacatcgacctttgtaatttttcttacgcattatattcctccttagttatgcatatatatgcatttttgttgaatataaatgcaccactctttgttaatggttttcccaaaaacgttcccaaaaagcgtattttttcccaaaaacacaaatttggggatttttcttcatttttgggaaaatttttgggaagagagaaacgtgtcaaccatgcgggtttgaaggcatttttatggttttcccaaaaacaggatttgggaaatactctatgtccttgtgcaaaatcaattatcctaattttgttaatgatttgcaaaaagaactatcctttctaaaatatctctctttttgtcttcatgagatatatacaaaaatatatgctttttgtgttatttatctcttgacatcacaccgctggactgttttctcatttcctgccgaacctgacagccggcctgctgtaaatctaacggatttatagtcttacttcccgtgctttcgcataaaatgccctttccactccattgatccatttatcttctgtgattcggtatgttccttttaaccggatattctcagaagaacttccaatttctgcatctatatcccctttttccaccttccagcgcatctgcctgtcaagaaaggctgactgatccgcctgcactgtaaatgtcactcgtactttctcctccggctccatatggatccgcttaaatccggcaagctctttcaccggacgtgtcatacttgcgaatctgtccctgagataaagctgtactacctcatccccggcacagtttcctgcattctttaccacacagctgatctgtaccgattcttctgctccaatctctgctgccgatatatgaatttctgaatactcaaaccgtgtataagacaatccatgcccgaagcaatatcgcggtgtatggggaagatccacatagttgacaaatccgatactctcctgctggtgccatgcagaaccgttcgggtgattataataaattggaatctgtccggcgtgatatgccacggataccggcagcttaccgcccgggttatatgcacccagcaggacatccgccacagcctgcgctcccgtttccgctgggttccaggcttctatgatggcatccagatattggtctgctgtgtcactggagattggtcttccatcaaaatgaaccccaatcaaaggcttaccacatgcagcggcagcctgaataaatgcatcctgacattccggcagattgatgtcggcagcgtccacaccttcgcccatggtcgccatagagcatgtgccgtgctttcctcccagagtcaggatcacagcatctgcttccctgactgcctgcagcgcttcttcaaatctgccctgatcctttccggcaaccggatacccgtatgcatacagaatctccgtgtctgtcatccgctccttcagttcttctaacaggcttctgcagtccggcttctgcaggcgcaggatatcatcaaaaagctccgcttcgtctgactggatctttgtacctgggacataattcaccggctcaccatttggcagcattgctccgctgatctgcccggactccgggctgccctctacccctgcgatggagcttgcaacagcgtagaccgactccatcatgcacagatgggtatatccgccgaagaacttacgggcacagtctacatgaggtccaatcagggcaagcttctttatcttacctgacaaaggaagtatcccgttgtttttcaggagtaccatggactctcttgctgaccggagagataactccgccccctctttctcttcaaaaatcttttgacaggactcaccatccatggcgaacggatgctcaaacagactcatgcggaacttggcttccaacacccgcagaacggttcggtccaacagttctgtatccgcctgtccgcttcggaacatttctttgagttcctcaccataaccgatcgctttcggcatctctatgtccatccctgcttccatggcaagaagccctgtttctccgatagtctccccgatccgctggacttcgtgggcattgttaatgccgccgtagtcgctgacacacagaccgtcaaaccccatcttttctctgagaatttccgtgagcagcctgtgtgaaacggaagccggttccccgtcaatggaattatagcagggcatcactcctttcagcccggattcagaaatcgcagactggaaaggcttgccgtatatttcttccatgaggcgggacggcgtatcgctgtttgtcccgtggataccaccctgtgaattgtgaaatccgagaaaatgcttggccacactttccggtcttctgccgcctgcctctgttgtctggattcctttcgtatatgccgttcccagagctgccgccaaagccgggtcttctccgtaggtctctccctgtcttcccatgcgggaatccctcgaaatatccagcactggtgccagaatgtgagtgatgccgcaggctgcttcctgttttgccaccactttggctatcttctcttccagctccggatcccatcctgagcctctggcgattccggaggggaaactggttccttcctgaataaatgctccgcacagtccctccatatgaaagattgccgggatatgatgagggctttgtctcatcacagtctcctgcatcttcctctgccatccagcggcctcttccagcgtgcctatcctgcgcatttccagagtactcacctgtccaatcccgtaaggcatctccaaagcctgctgttccatatcatcatagctgtcgccaaatgggaaaatgcagccaagctgcgccatcttctcgtctaaagtcatttcttcgagaagtgcccgtgcccgttcagccggggttctctcggtgtctgtatattttaccttctgctgtaccatttactttcttctccttttacatctgcgcattcaattcttttagtacggcttcataaaccgcttttacctctggggcagagctgattccttcagccagagtcatttgccttgcatactcgatcattggattgtgtacaagctccggcagcatctcttccatcatcttcatgccaagaggttcgtccagaatctctcccagtgtactgtccaaagtgaatttcagctcttttaaacttgtgtttgtgtcatattcatacacatatgttcccgatcccacctcaaaggattcctctttttccggcaggaacagctccgccctcgtattggcaggtacgctgacctccacacggatctttccattgcggcagctccaacaggaaacaatctttccgtaaggagactccagctctgtccttacctcttcgattccccttacaaacatcggttttacataaaatctcctgtatccggctttcgtctggtttataccgccgattttccgatacatccaatcgccgatcgctccatttgcatagtggttcatagaattaagccccggatcttgcatggtgccgtccggcaggacggcgtcccacctctcccaaagcgtcgtcgcgcccttattcacagcatacagccatgatggcagatcctctctcacaaacaggagtccggccgtatcatgcgctttgttctcagacaaggcatgacataaatacggcgtccctacaaatcctgtggtcaaatgattctgatgatcttctatattgctcaccagcatttgtacaatattttccctatccttttcatatgccaggttaaaatagagagacagcgcgcatgcagtctgagtctcgctgacgatcctgcctcttgcggtgtaatattctttcctgaaagagtccagcgtcttttcatggagcacttcataatatgccgcctcttcatattttcccagcacatgagccgtctttgccacaagctctgtgacgtatatatagtaagcgtttgccacaaagtaaacatctgtagctccaacgcttttatctcccatctcacgatccagtgccagccagtcaccatactggtaattggtcatccacagcccgttttcatttacatgattgtgaatataatctacccactcgtgcatacatttccatgattcttctaaaatacgtgtgtctccatacgtctggtagactacccatggtataatcactgccgcatcgctccacgccgcggaactgtaagttccctgtatgtccggtactatatgaggcactccccgttccagtgaagacgccgccgatatatccctcatccattttgtaaaaaacagagccgtctcccggttgaacgctgctgtccatgagaatacctgcgcatctcccatccatccaagccgctcatccctttgaggacagtcggaggggatatcaaagaaattatcacgcagactccaggaaatattgctctgaagctggttcactttttcattggaacatcggaactctccggtctttctcatgtccgaatgcgttacgcaggctgtaaacatctcaggtcggggattctctattccctccacggcagcataccggaaaccatgaaatgtaaagtggggcatcaaaacctgttcttccccgtttaggatataggtgtcctcggattttgccgtccgcagagtgtccgggtaaaatacaccgtcctgatccagagtctccgcatggcggacagtgattttctggcctttttctccccggattctgatttctacaagacctgtaaggttctggccgaaatctacaagtatattccctttggaatccgtgaaaaccctctttgccttcaagcgctcagtcacccgcaccggttcatttagctgcggcgtcaatacagtcggatgaaatacggcttctggcacggcagatacttttccctctctgatattaggggcatttgtatcaattgtctctcccatgtaaatctcactgtaacgaatctggccggtacgcacatgccatgtctcatccgtagtaattacctcttctgtcccgtctgtataacgcacatgaagctctgcccaaacagcagtccgatccccataccggtccggcttacagtcaaagctgagaatccctttataccagccgttgcccacggtcaattccaggacattttcctgtcctgtcccttgcagcctgtctgtcacatcataatattgatactgcaaaatcttatggtaatttgtccagccgggtgccatgtaataatcttctaccctttttccgttcagggtaatttcatagacaccaagcgccgtggcgtaaaggcaggcagatgacacttccttgtccggagaaaatttccggaagaataccggacaagccatctcctcaggagggaaatcatgcgtaatcatcttggcctgaaaatctccggtatcaaaaatacctgttgtaaaagctgtttctgcttttgctctatttccataattgtcccagatttcgagagaaacctgatactcctgttctctggtaagcgcttgtccggcataaggaaccagcacagactgatcactctcaatctttccactgtcccagaagcatttttctgcactgctcacaatcaaatgccatgctgtctgcaccacattgttgtcacctgatgcgatcttccatgaaaagcggggaatcttcacagccagtcctttgggctgttccctgtattctatcctgaaatcataaattttcattcttgtcttctccttcctgcctgtccattcccctattactattttccgcctataactcaagccggcgctccgattccgacggaagcgccggctctcataattacaatgtttctttcagctttgcctgcttcttaataatatctgtttcttatttttcaatggtctttcctgctctgcgcgcagcgatttcctcgcgcatcttcggcagtttttcttccagatcgaatttcaggaagattacaaacatcacaaggttgatcacaaccggaagataatttgagactccatagatggaatatctcatggatgtacttgcgacttccagcgtggcatcatatgcaccgattgccaggaacgccgacagtactgctgcaccaaggccatttccaaccttactgccaaagccgattgctccgcccgacattgccaccagcttcttatcatatttccactcattgtaatcaatggtcatagatgtcagcacgccatacagactcatcatcggaatctgtacaaagctgcctaacagaccggtcaccacacaaactgtaaagttcgtcggtataaagcagcgaatgcctgcgagtatcgccgctcctaagagcccgatggagattgtcctcttgattccaagtccggcaataatcggcttggataagatgaatcccactacggtagccaacatacctgctgctccgattattccgaccagattatcatttccgaaaatccatttacagtagtatatactgccagatgccgtgataccgctcgtaacacttgtgatcaagttaaagagcaggatgatcacccagtatttattcttcagaagcattgtcattgcttctttgaaaggaaccggctcttcctcttcttcagcagctccctcggtttcttcttcgtaatcacatgcaaatttggctttgcggccgttatggcagcagattgcaaacaggacaaataccagtacaccaagtaccacgccgtatttgatccatgcggactgtgtgccgcccagcatatttgtcaccgggatcgtgagaatggagatcagcattccagcgccataattggcaaccgcacggaacagcccgatacttcctctctcgctcaagcttctgcttcgtacagtcataactgctgaaaacggggtcgcaataaaggtataaagacctgcggacaataccagattcgtaatcagcgcgtagattacgcccggaatctggcctgcctgaatcggtacggtaaacatcagaaccataatcagggctgccggaataatctgcggcaggatccatctgaaatacttatggtcacctccttttgaatgatcgatagccatgagcaaaactccacacattcagtatttatgcgggtttgcgaggcatggcaacctcattaatcacttcaaaacggaaccgactggaatggtatcatcggtataaaagggttcttcaatcctacaacacttgccgatgccgacggacttttcaacggactgccaatcggagtcttccttattttccatacagtattctgcgccacatccgctactatcgtatccggttctatggcagaacgtacaaaattccttgcttacttattgtatagtgcagcaatcagtatttttatttacccggtaaccggccactggatctggggcggtggatggctcgctcagatgggattccacgattttgcaggttccacagcagtccatatggtcggcggtatctgtgcacttgttggtgccaaaatcctcggacctcgtattggaaaatatgataaagaaggaaatgcccgtgcgattcccggacacaacctttccattgcagctcttggcgtatttattctctggttctgctggttcggtttcaactgcggctctaccacagcagcttccacaaacctcggtgatatcgcaatgacaaccaatcttgccgctgctgccgcaacacttgcaacccttgttgtaacctggatccgctatggaaaaccagatgtatccatgacattcaacggttccctcgccggactcgtagcaatcaccgccggatgcgacaccgtcagcaactactctgcaatcatcatcggactgatcgctggtatcctcgtcgtattctctgtagaattcttcgacaaagtagccaagattgatgacccggtaggtgcgatcagtgtccacggcgtatgcggtttcacaggcagtatcctcgtcggagtcttctccccggaatacaccctcaaaacccaggtgatcggtgtcctttcaaccgtagcctacgtcctcgtaatggcaatcatcgtattcaccatcatcgataaaaccgtaggcctccgcgtcaccaaaggagaagaactcgacggtctcgatatccacgaacacggctgctcagcatatgcagactttaacttccgtttatagccgggcgaagtaagaaaaaaagatatagccactggaatgctcgcatttcagtggctatatctttttttcttagtgagcggctacgcgactgaggaaagtcatcagactttccgaggttcgcccggcggacgtcttgtactacctttatcattctacatcccctgcaatccttgcatttcagaggctgtatctttttattttaatgagcggctacgcgactgaggaaagtcatcagactttccgaggttcgcccggcggacgtcttgtactacctttatcattctaccacttcttattcttcagcacgatcgccgatttcttacccatcatcagtgaaatatttccctctttcacgatatactcttcgaattctccaatatacccatcttcataagaatacatcactcgcgccatattatgtccttcggcaacttctgcctgccataccggaacccttacttccttcagatgatcggaattattgataataaccacgatctgctcattcccccagaatcttccataggccagaagatccggttctgctttcagcatcttgattgatccctttctgagagccagagactttctgtggatttggatcatctcacggtagaaattgatcagatcccggttttctcttccccacggataagttctccggttatccggatccgtgaaaccacaaagtcctgcttcgtctccataataaagggtcggtgctcccggccaggtcatctgcatgatgatcgcttcccgcataactgcaaggcttaccccttcttctgccgcacgcgacccaagctgtcccacacggccaaccttgtggttggtacgcgtcaggaaacgggaatggtcatggtttgacaactggttcatcgccgtctgaagtgacggtgtcatcatatttgccatatgatgcttcatcgcattcataaaatggtctgcatttccgagaagatcgtcgcgatattcatcactgtgtttctccatcccggtcagaaaccaggtgaccggctccataaatgcatcgtaattcataacgctgtcccattcatcgccctgcagccagtcactcggatctccatagtgctcggcaaggatcagtgcatgtggatttgcttcttttactgccttacgaaatttcttccaaaattcatgattgtactcattgcttcttccaaggtctgccgcaacatccagtctccagccgtctacattatacggcggtgaaacccatttctttgcgataccaagaacatactcttccagctcttttgaatcttcataattcagctttggcagcgtatcgtgtccccaccagccgtcatagcttccattgcccggccattcattctccccggtacggtggaatagaaaataattccggtacggactcttcggtgacacaaaagcacctacttcgtaaccatcggcgctctcgtagatcagctctctgtccagccatttattgaaagaaccacaatggttgaagacgccgtcaatgatgattcgcattcccctcttatggagttcttctaccagcttgatgaacagccggttacttgcttccagattctcttttctggtagttcttgtccggtaacggtccgcatggatattgttattttctcccggatccagaagccttccttcatcgacttcaattttaccgacatgcggatcaatataatcgtaatcctgtgtgtcatatttatgattagatggtgatacaaatagtggattacaatagacaacttctactccaagtccatgcaggtaatccagtttatcaatgatcccctggatatctcctccgtaaaattcccgtacatccatcggctgcggatcccggtaccagtcatctacatgctgaacctgttctccaatataaaagtactctcccgtctgtacatcattatccgggtcgccgttacagaagcggtctgtataaatctgatacatgaccgctccttttgcccaatccggtgccgtaaagcccggcacgattttaaaatcataataatccacaagtttgctctctgctccccatttgttatagtagcagatctcatttcctgatctgatcttaaaatgataccggaatggtttatcttctaatttgtatttcacttcataaaagtcaaatgccttatttgagattactttgttcattggaatgcatagttcgcggttttccagatagacttcatctacgtcgtgagctgctgtacggaaccacaactgaagttcatctcctgcctccggttccggcggactcacatacgcctctgttccatcacaaaacaatgcttcttttttcataatctagcctctattcttcaaataatgcttcaaattcttctcttgtaatcttctctttttcaagaagcagatctgcacatttataaagaacagcttcatgctctttaataatggtctttgcacggtcataacattcatcaatgatccgcttcacttcactgtcgatcgttgtggcaacctgttcaccataacctctggaggtatgaccaaaatctcttccgataaatacttcatcattatcatctccatagcttacaagaccaagtgcttccgacataccgaacttcgttaccatggatttggcgtatgctgttgcctgcttgatatcctgggatgccccggttgtaatatcatcaaagatcagctcttctgccacacgtccacctagtgatacggtaatatcctgcaacatctttcctttggtattgaacatctcatccttttcaggaagcggcatcgtatatccggctgcccctacaccggtaggaatgatcgacacgctgtacaccggtcctacatccggaagtacatggaataagatggcatgtcctgcttcatggaatgcagtgatcttcttctctttatcagaaattacacgactcttcttctctgcaccgattccgacttttacaaatgctctgcggatatcctcctgttgcagatacactcttccatcctttgctgcaaggatcgcagcctcattcagaagattttccagatcagctccggtaaatcctgccgttgttctcgcaacctgttccagatccacatcatccccgagcggtttgcccttggcatgaacctgaaggatttccaggcgtccctttacatccggtctgccgaccatgactttacggtcaaaacgtcccggtcttaagatcgccggatcaagaatatcgacacggttggttgctgcaagtacgatgattccttcattcgcgccaaaaccatccatctctacgaggagttggttcagcgtctgctctctctcatcatgtccgccgcccataccggttccacgacgtcttgccacggcatcgatctcatcgataaaaataatacaaggtgcatttttcttagcatcctcgaaaagatctcttacacgggatgctccgacaccgacaaacatctccacaaaatcagagcctgaaatggtaaagaacgggacacctgcttctcctgcaattgctcttgcaagaagcgtcttacctgttcccggaggtccttcaagaaggacacctttagggattctggctcctacctgcgtatacttcccggggctcttgaggaaatccacgatctctgcaagctcttccttttcttcctgcagtccggcaacctgcgcaaacgtcacatggttttcttcctgcgtgctcatctttgccctgctctttccgaagttcatcgcttttgcattcgatccgccctgacgattcatcatcatcacaacaaataccatgatacctgccatcaatatgatcggaaccagtgttgttgacatccagctgtcctgcgggacattgtccacactgtaggaaatatcataagattcaagcagatcctctgcactgttgacatcggatacatgaagctgttcgatgtcatcattcttcagccggatcttcagtgtcccggtcggtgcgactttgttctgcttgacctctacactttctaccttctcttttttcagatctttctgaaaatcctgatacgtgtatgctgtctgctgcacacccgactggctcataaaccagtacacacctgccagcaccagaacacagagcagaatcgaaagaccactgattcctcttgtcttattattattcaaaacctgctccttccacctgttacatctctacacttccgatgtacggtaagtttctatatttttgtgcataatccagaccgaatcctaccacaaattcatccgggatattaaatccgacataatctacatgtacatcgcgcacacgacgatccggtttatcaagaagtgtacaaagcttcatgctcttcggtcctctcttccgaaggatgtcaagcagataataaagagtacgtcctgaatctacgatatcctcaacaacaattacgtcttttccttccagagactcatccagatcttttgcaatcttaacaattccactggactgggttccgtcaccatagctgctgacactcataaagtccattgttaccggcactgtaatcctttttgccagttcacacataaagaacactccaccctttaaaacacagatcagatgaacctgctttcccgcatattcttcactgattttttttccaagttcttcaattctagcatttacttcttcttccggaattaacattttcactttctcggccatttaaagtacctccatttatcgtaatttctaatattttcgttgtctgctctgtcacctggtatgccttgctctgccggcagcccacaatccataaaatctcgcttccctctgcgatcagaggaattccggcacgttctgccactggtatttttttattgataaaataggatttcagcttctgccttcctccgctttcatcaattacaataaaatcgccagcccttctggtgcgtacagcgacactctgttttattataccataatcaaaccatttcgtgtacgtttttttcgggatctggcatctgcattcttctttttcaaaaatacctttcaaaagaatatgcggagaaattcattcaggaattggtatccacagcagcaaatttacatcttcctatcgatggcattgtcatgatttttgacagtctcagctactccaaaagctgcggaaaaaccggacaccactataaggacggcctcgcctataagtttgaggatgatacctacgaaactttcttgcgtgaaattgaatggacaccgaccagattcggagagattgctccggtcggcatcttcgataccgtggagattgacggctgtgatgtttccagagcttcccttcataatctgacctttatcaaaaatctggagcttgtacccggatgccggattcttgtttccaaacgaaacatgatcatcccacatatagaggataatctggatcgtggaaggtataccgacatcacgcctccggtctgcccttgctgtggttccaaaaccagaacctacagccgtaagaccagcgacggtcgcaccgtagaaactctgcattgtgataatccgcagtgcgacagccagatcacaagaaggtttgtccattttgccagcaagaaggcaatgaacatcgaaggactgtcagaagccactttagaaaaattcctgaatctgggctatctgcactcttttcaggacatctatcatctggaggaacaccgggaagatattgtggcactggacggatatggtgagaaatctttcgaccgcttgtgggaatccatcaacgccagccggaggaccagctttgtccgctatctggtttccatggatattcctatgatcggcagaaccaaaagccggattctggacaccgtattttccggaaatttaactgcatttgaacaggcggctgtcggagattacgacttcactcagttagaggattttggcgaaatcttaaatcacaacatccattcctggtttgcagatgaagcaaatcttgatttatggaaaaacttacagaacgaattcacatttgaacaaagaaaggaagagaccattatgacaaaagaaaacaaatttacaggatgtaccatcgtagcaacagggaaactggagcattttaccagagacggtatcaacgataagattctggagcttggtgccaaacctggcagctctgtaacaaagaaaaccgattacctgatctgcggggaaaaagccggcagcaaactggcaaaagcccagagccttggtattccaattcttacagaagctgaatttttggagatgattgcataaccatctctgcaatagatgagaattattttgaggtgtggctgaaaggccgcacctcttttacaaaggaggaatttataatgaatcaaacaaatacaagcaagcgcatacctacacagatcaatgaatttcggggagattatgcttttctaagcaatttctatccggcaccggtctcttacatgggacaaacctatgcaaataatgaagctgcttttcaagcgcagaaaacactctctgcgagagagcaacgcaaattctgtatttttcggatgcataatccttctgatgcaaagaaactcggcagagatcttacattacgcccggactgggaaaaagtgaaagtccggctcatgtatgaaatctgcatgtgcaaattcatgcagaacccggaactccgggataaacttcttgcaaccggagagtccacacttattgaaggaaacaactggggtgactatttctggggcaaagtcaataactgcggagaaaaccagttaggaatcatcctgatggatgtacgtgcgaagctgcagtggaatgcagaaacagcgcccaataatatacctcaatgtctgcaataaaggaaaggatggtctaatagaatgaatgaaaatgcaaaaacaaaattagtgcttgagtatactggcatggatgatttttcctgtccggtatataaggaccaattcggaaagttgtggaaggatattgaccttggcaaagagcctgaaccgaatctttattctttatcttttaaccatattgatggagaaccttcccatcccatacagcaggagtacacatttcatccggctccgtatcaaagaagttcctatgaattcgagtaccggatgttaagtaaattacagtctgactgtgaatactatctgggctacggaaatcgcagtccgtctatcctatgcaatcatagcgttcaaaaccatattgcccgtatgaaagaattatggaatggttttcccacagatcagaaaccggaatggctgacctgggaacagcttcttcagtacgaaaaagtaatgacagaaaccggaatacccgtgaagaactgctcagactagacaattcatcatttatcagaaattaccctctatattatccattcatattttgatataataggaacagttgaaagaaaggagcatttcccatgtatctgaaaagaaaagtttacgatcagcttctggattggaaaaacgataccgtccacagcaccttggaagtgaatggtgccagacaggtcggaaaaacatatattatcaataaatttgcggatgagaacttcaggcacaagatctacattaacctgtttgatttgtccggcaaacaatttatggaatgttacaaaaaagccacagactggactcccggtacaaaacgaccggagcagccgcttcacgatgcttttaaactcttcgatccggattttgaagataccaacgatacagtcatcattattgatgaaattcaggaatcctcagagatattcaaccgtatccgagaatttacccgctattttcaagcgcatttcattgtaactggaagttatctgggacgtgtactggaaccggaattcaaattctccagtggagatattaccagtatccgtatttataccctttcctttaaagagtttttggaagcattggatgaccagctttttcagaagtatctatcacttccactggatcatgcagatgacaccgtaccggaactatatgacgaattaaagaatgtttacgacatctatagacagattggcggctatccaaaggttgtggaaacataccttaacacaaaagacgtggaagcagctcaaaaagagcttgttagaatcatccgcattttcttaaacgaatctatgcggtactttgatgacatcacagatattagtgtttttaccaacatctttttaagcatctgccgtattctgcttcgtgaaaagaaaggattagatgaggacagtataagtgaagaactgcaaaagctcgttacaaagaattactccagtaatctttctaaagcaacctgctatcgtgctatcaactggctttaccattctggaatcatcggtttctgtggcaaaatcacagaactggacatcttgaatttcaaaccgggaagccgctgcttcttcatggatcttggagttgcatattattatctctccagaactggtgctactgtatcaactatggatggctcattgaacgaaaactatgtttacattaacttgtccaaacgccaggaattcccggaagaaattatctttgagacaccggcttttgctacttataaaggtggtgaaattgattttgtagctcagacattgaaaactcacatccgctatctgattgaagttaaagccggtaagggaactgcatctactgccttgaaggcattggaacaggggaaggccaataaactactatatctgaaaggtgataccaaaggcggaaccgttggaaacgtacaaacacttcctatctatctgctagaacaatatcatttttaatcaaagaaagaatacttcgagccgcccatccggacggctcttttcatctatattcttgtatatttattttactaacagcgcatcattctttgaaagaagatatatacagtattgattcatactgatgccttctttttttgagtgttccgccagatcccggtgtaagctgcgtggcatccttattttaaactgtcccgaatactcttccaggcttcccggttcgtgaatctcaatcccttcttccagtgcagcttctaaccatgctttttttgcatccgctgcattttcaactgccctttctatcgtctctccacaggtgatgcatcccggcagttccggataagaaaccacaaatccaccttcatccttatcttccacaatttccatgcgataggacattgccaaataatcattcagtgtcttcatcgtttttcgcctcactttctacaatctgctttaccatttcaacataaattttcttgattggttcgtgtttcggtattgttatcggctggcatcccgctttacggaatgtataatggctgctcccacttctcggagcatttatctcatatccataactttctaatacttttcttagttcatcaaaacgaaggtctttcgataatgagcaaattcttgtcaatagtttatcccatttcgacatctttaatgcctcctatctatagtatatgtggtgtcatatgtggtgtcaatctgtttttcatctttcttggtcaaataaggctgcagctctttcttagcagccgtcacaaattcttcttttctcgaacttaccatataaatcttccagagcatcagattcagcttttccgcatccactgctttgcatttctttttaatcatgcggataaacggatagattaccgtatccgataacttgttcccagcaatcaacatcgttccatccgttccatatacctcatacagacattccaaaatactccccaaatctgtcaccaatcggaatgccggcttttcatatttctttttagcttccatcatatgctcctcctacattcgaaccgtcagtccactgagactcgtcttaggaagccctaccagataccagtcttcatccatttcaatccgaaccggaatccatgcatcctttaccttcacatcaaaacattctccgcaatgaagacctccataataagattcaatcccaaaccggatatcaaatcttcccattgatggatcataaattaaagtacctattctcttttcactcatatttctttcctcctgaaattctttggtctatataagtaataggactttaatttgcagaatttgaaagttccgggtatttttcataaaaagtttttcgatagcgataaaaagttgagtgcgtcattcccaaatttttacgaagctgtgtaggtgtcgtttctccagaaactacgctttgaaagttctcatcaaaagtttcctgcttcatcacacttggtcttccataatcatcccattcgccccgcaatttcttcgcttctatcccttcccgctgtcgcttctcctttttctccagctctgcctgcgccatagaagcataaagctccagcatcatgttattgattgtttccagcatcatccttgccatcgcattatccatcacagataaatccataagcgtagtcggcagttccagaaccataagccgcactcccatgttcttaatccgctggatctgttgcatggtgtcatacttgtttcttcccagtctgtccaattctgtaacaatcaaaatatctcccggccgcaggacatcctccactaaaacggtatatctcggacgattaaaattcttccctgtctcctgatccgtaaaaatattcgtaagtgccatctcatgctcgttacagtaccgctcaatttcctgtatgccacggtcaagatgctgctcctttgtactggtacggtgatatccatatatctgcatccacatttctcctttccatgtcccaaaatatccacacttttattggtatatttcaaaactgtgtgtgtaacctttttgaaatataatccctctttccggaacgtacttctaaaatgtatacattttgggatatgtttcttttctatttctgtacgtaccagagccgaaaagtgcaacaaatatgacaaaaaactcccagaggatgttactcccctgagagtggttgaaacttatagcccacacctcggacggtgcggatgtaattccagttctgcagacagcggcaacagttttatctccaatcttccagtgccgaaaggaacggctctgagtgatgagaagtattggagtctgttcagcctgcatagtgagcagatcgcagaggcagaggagcatctgacccagacggccgaagatatccgctcagagctttcggaaacagaaaaccggatcaacaaaaatgtatccgacacggaaagccgtatcaatgaaagtctctccagcacagaaagtaaggtaaacaccagcctgtccgagacagaaaaccgtgtgactgcacgtgtggagaatgcaaaatcggatctgactgcaaaagtcgctgcggcagagcagcagatgaaccagaacgcccaggatgtcgcacagacaaacaaggctctgaatgcccggatggaccagattgcaaaagggagaacctctgacacagaagtccttgatgcaagagtggattcggaggggaatacctttgacaaccttggagcagcaatccgttccatctatccgaaagcaaaagaagggctggatgcactgcaggaatccaaggtggatgcaaactatgatgcgaccggcgaactgacagaaggcattacagtcaacacaatcaacggagaaacgcagaagtttgagcatgtccagacgacagcactgatcccggtagataccgcctgccagaaggtctactataccgggcaggtgttcaactggatcggagttgcaggctatgatgccaatggtacgtttgtggcatccattctggattccagggacacagaacagccgcaggagtacaaagaaaaggaattggagatcccggaaggggtattccagatccgggcaagctcctatgcgaaggacctgagcctgaaggtgtgcggagagtctgcaaagctgtggaatcaggttcagagggagcgacagaatcagaaaaagatggcagtcgagatcgaagcactgcgaagtgcggatgatgcactggcaaaggaaacgatgaccagtttgaacctgccctttttatatgacggtgtcagcaatatctgggaaggcagcagtccggtactccagacctactatgtgccgctgactgttctgcgaagtgtgtttatacaggaaatccagttcacactccgaaccattggggagacgaccctgactgccatgcttgaatcggaagaaggcgaggtgttccgccagtcggtagaactagtgaagggagataacaggatcaccctgattctgcaccgatttatagatgaaggagcatacaaactgcgtgtgcgcagtacagacaaggtgctctattatccggtgcgtccgagtaccggaaaagaaatccgcaacgatttcttcagcaatgaaccgtccgggaatgtggagtatgattacaaaaaccgtctaatcgtctttatgggcaagatcctgattggtacaggtaaggtggatacgacgctatcctattccggaatggctgcggatgccgccgttgtaggacaggctttcaaggatgagcgggaatacacggataccctggcatccggcaagctggatgcagtccatagccgaaacctcctcgacccttccaggtatcgtccgggatggtttgcctatgtacactcgtccgttattcagtatcatgcagacaatctccgatatggttccacggattatatcccggtcagcgagaaaggtcttgtgaccaaaggctccggcacgaacggtgtaaccagccaggtcgtgtttgacaaagcgaagaaggcgctccgttatgtggatgccaatgaccagtacacttatcaggaaggcgatgcctatgtgatgttcttctatatggcatcttccggacagaaactctgtgttgttgagggaacggaatatgtatacgaatcatacacggattataagccgctggatgatctgaaacaggaagtgaactctctgcagacggaggcggataaccagaaaaagcagttgacaaatctgactgcccggctggatcagatggtggccgtgccggaaaagaaagaccttcgccttgccccggcggctccggtgtatacggtctgcaataacctttcgaccgccagaaattatcatgtttcagtctgggtggaccatctgatcgctgagacaggctggaaggatagagcggctggttttggtacggagatggaggagcgctttgacttgtattcaccgtttaccaacacggcagtcaacagcggggaggatgttctggaacagacggtagagaaatcgtttgtgtcagatgtctataagacgcagaaactcaaatttaagcaccgcagcaccttggccagtatgggaaagaaccagtttccgaagatccttgtcatcggtgacagtgtgacggatgggtatctggctggtgttgggaaaacagatgcggatcttccaatccattattggtcgtgggtgcgttacctgtttgacctggatcgcaaagacgcgaaagcagcagaaaccgaataccgctgtctgatggtcggcatgccgggaacagtgaatggcaagcattacggttcctcttcctcgtacaagctggatggaaagacggttgtgaactatgcgatgggaaagggcggctggagtgcagaagacctgaaccttgcaacttttgagagcgcatccaatattaacccgttctacgatgaaaagacgaagggcttctcactgaaggcttgtctggataaatacaggacgttggcggataacggcatgacccggcttatccccggcgaaaccgcaggcacggaagtaaaagatgccaacgcttatgacctgtgcacgccgacccatgtggtgatcaacttaaaccacaacagttcccttgcagagtacaaaaccaatatcccggatatcgtgaaaacgatcaagcgtgagtatccggatatcatcgtgatcctcatgtccattgatgagaccggcacttacttcccggcaaaatacccggagtaccgggcttctgagatcacgctgggcggacttcacagcaagaatgtgagcatctaccagtatttctgcgatgaactgcaggatgaggcaaacggtgtctatgtatgcagtgggcatctgatccagcctgccgtggagagttaccctacactggattatgtgtctgcggattcggtcggcagacagagcggcagggtactgcacatggcatatggccgaggccagtacggaggtcccaactggcatccgaacaactacgcacactgcgcatggggctatcagctgtatgcgctggtcaagtatacactggcactacaggatatgaaatgatgccggaaatatcccggagaaaggaaaagctatgatgaatcgtaataattgtctgaaaattcggggggggggtatcggattatctgacctgtgcagtgacctgatctcttctgtgctgaggggaggtgtgttctatgcctaagtatgttggcagacgcatcgtcccgaagcatggcggcatctgggacaagacaaaagagtacgaggaactgatcatcgtgctgtgtcaggaaactggtgtcagctatatctccaagctgccggtcccggctggaacggaaatctttaatgaacactactggtctgtatgcagtcagttcagtgagcagatcaggctggcagaggatcatctgacccagacagcagaggacgtccatacggaactgacagaaacagaaagccgcatcagtaaaaatgtgtccgaaacggaagaaagggttacccagaaactcacggatacggtgcagaacgtgaataacagcctgagtgatacgaccactacgctggcgaagaaggtggcaggtgctcagaagcagctggaggatggacggacggccatgcagcagagtgcagcatccctgaattccaggatgaacagcattgcatccggtaagactacggacaaggagactctggatgcgcgggtcgattcggcagggaagacctatgactcatttggtgcacacttacggtccagagccgataagttctatgccaacggtatgcctttctcttatacaggagcagtcaatctgaataccacagagcatcagctggagttttctgggaattttatctatctgggtgcgaaggggaataagctgcttacgaaaccagagccggttccatataacccggatgctcttttgacctatatctcctacgatacagtggaagggacgctggtgacagcggactggtcggattctccaaaagagaatgatatcatcgtttttgtagtggactgtaaatatccggaacggtcttatggctactttccgttcaaggtggatggcagaatgccgtttggcgaccatacgctgtccggcacgatgcttcgggataaatcggtggacggacagaaactcctggatgctaccgttacaaaggataaactcgcagatgcctgtgtaagcgcggcaaaacttgcacgggatgcgctgatgtcacagagccttgaagttccattccagccctgtgtcttttccaaaggaaaatgggagatcgtggatgaaggagccaccatccatcattttttgacggagtatgagagcgggtattatggcggcggcattaaagttccccgtgcggagcggtttgataagctctatgtcgagatggattactgcaacgaccagctgatgcactactatgtggttggttcaaagctggtgaaccttgggtcaatcgcttctacggatggaaaaccaaagagaatcacgcttgaaattccatccaaaaagctggaagatgccgggtataaggatgactatatccagatcgtgttcacgaagaacagcacctacgatatgaccatgtccaacgtaaaggcacattacttcaatgtgaagggcagctactttggggaagattacagcctccttcatgagcaggctgacaccaatacaaaggagcttgctgccttgtcggaaaaggtccgtgtaaatgcggatgcgatcaaaacagcagatgcgaatatgcagaacctttccaaaacgatcagttccgtgtctacggatatgcaggtggtcatgaagcagaaatctgcgttcaccggaaagaagatcctgtttttgggagacagcatcacggcactgaacacatcggagcgtggctgggtaagatacttcaatgagatcatccagccggagcggtttgtaaacctgtcggtatccagtgccagatggtgcgattatgaggacagcgtttacgatggcaacccggtcttttccggaccggatcagaaccacaacaatgtcatgggcaatcaggtggaaaaactcatccgaggcaaggacaagaccagccctcactacaaggaagtgactgcctacgccgactttgatatgatcctgatcgcctgtggtacgaatgatggtgttccttccggcgatatggaaggctctttcacttcagagaatgaaatggtcgctatcgaagagctggaccgcagggcgtttgcatcagcattccggtacagcatcgaaaaacttcagcagctgtacccggcggcgaagatttatatctgtacgccgatccagggctatatcacgactcggagctatgcacagtccaaggcgaaaggcgattatttgaaacttcttgccggcaggatgtctctggaaatcattgatactttctgctgtggtatctgtgacatttacgagaaaaagaatgccaatggccgctatctgattgatggtctgcatccgaatgcggcaggcgcaaagaagatcggagtgttcaatgccagtgcagtgattgccaactatcgataatcaaatcccacggtttgtccgtgtttttatatataatccatatcaaagggcagcttcggctgtctatttttattgcccggatacgggcggaaaggacggaattatgcagaatgtgatcgacaagattgaatggatgttcgcgggcctgggtggtttcctgttaccaaatcttcttggtcggctcacgcagatatacttctgttctgtacaaagaacttcgtttgtttttgcaatcaatttgcttttatctacatatattttagagcgaagacttcctttaaacgaaaaatttcccggattcagataactgcccatgcaaattcctcccatcaaagttttatagaatatattatacttgattctcttaataatcacaagcaattcgcgcatcgaacacaagagtcaacattcaatcccgcaaattatactttagtcatactcacactctttcaataaacattcaaccgccatccggtattcccggatggtctggcttttgcggatttgcgtcagatattcttcgctgtttttaaagtttttgccaagataccaccagagttctttcattttgactactgcgtttttttcttctggagatttttcgatatagacatcaagaagatgatcgcagaatgtagcaatcttcttggtgtcaaatgtagatttcccttttatcactgccggaagaaatgggttcatcagaattcctcttccgagcatgatgcattctatttcgggaaatttttgatggaagatttggtaattttccgcacaaaaaatgtctccattatagaccagaggatttttgctgttccggcaggcgtaggcaaaagtggtccagtcgggtttgtttttgtagtaatcctgctggactcttggatgaaggatcagttcttccagaggatattggttatagatatccagaagctcttcgaactcttcctgatcatatttaccgcttcttgttttgatagagattttcatatcgagttgatcgaaaacttcggcaaggaaatgattcagttcatcgggataaaacaaaaaaccggatccccttttccggttgacgactgttttggaggggcagccgagattcagattgacttcttcatatccgaattctttcaactgccgggccaggcggatgaaatcctcggcgcggttggtcaggatctgcggaacggtatacatgccctcattattttccggaaggatctcattccattcctgtctgctgaatttgcctttcgggtttggatttaaaaatggtgtaaaatatttatccattggttcaaaaaaggtgtgatacgccctgcggtatacctcacctgtaatgccctccattggcgccagatagattttcatgacctttctacctccgtcacataaagtgtttctttgtctacccggaaatgaatttccattcccgcgtaagacatgccgtaaatccggactgaatccttttgataagaaggtctcggatcctgctccaggatctgaatcagtgctgctcttttttcagccggaatctgttccaaatacatttccgggaaattcacatccaatttataatctttcttttcttccgcgaaaccgccttttgcctccgggtggctatccacgtatggaaggtagggcttgatatcgtagatcggcgtcatatccagaagatccgcaccttccacgatcagcaccggaccttctttttcccggaattccaccccaataagctttaccgaagaaagtccgatcggattcgggcgaaatggagaacgggtggcaaaaactcccacccgtctgttaccaccaagccgcggtggacgtaccgtcgggctccatgtatcccggatagattccgaaaattcccagatcagccacagataatcatacgcctcgatttcccgcagtgcatccgcattctgatattccggcagaaaatggatttctgcccgggtatccgcaagattactctgtcgcggaatcccgaatttctccacaaaatcggatcttatatacgcgatctgctttatttgcattgttctttttctccatcaacaaacatcatcacaaaagcaactgccagaattgcagaagcgatcagaagtgccttttcagcaaacatttccacacaggcatttccgataactgcaccgatcacaaagaagaagatgattccatagtacaaaagtcctttcttgatatactctttatccttcgtgttcgcataactgcacatatgctgggtcgcacttcgtaagtttccgatgcacatggtggttgcaattccgtttccatggattttgcggaagctttccacctgaatcccacacgcaagggacgtgagtgcattcgccaccagattaaaatcctgtgggataaagctgacactcagtaggatcactgcctcacagaataccgaaatctgtctccagtgcagaagtgtcagatttttcgtccgtattttcaccaggtccgcaagggcgattccaatggcaaatgccagcaccggaaccagatagcggagtgccatctgccagtttctctctgaaatattgattccaagaagcagaatatttccggtttgtgcattggcaaatacttttcctctgcacatataggaataggcatccataaatccaccggcaatcgcaaggatcacaccaagtttaattgattctgacatctgttttgaaaatttcaagttactcatcctctctgtcgtatgctttgatgtatacaaaattctcattgtttcgttctgtatgataatccaaattcagtgccgcgtcaagaaaatccttaccaccggactccactgccttcaccgtcatgccaagtgccgcttccacgtcctgcaccgtcagatcatccagaaagacctcttctccgcttcgcagcatattgatcggaatctgcagagtatctcccagatcctctcctgcttcttttctctcttttaactgtgccaccagatcctgtccggtaatcagaccggatacggtgatcgtctcaccaaagaaatcattacggatgcaggcaaccgtgatctttacttttggaaatgcttccgtgatcctgtctgcaaattcctgaattgtcggatacgcaagctttgcagtcgcaatggtaaatgtccgtgcaatcccttcttttaactttggatattcttcactttcctgaagctcttcaaaggcatggtaaaattcatcccgtagaagccgcatcatgccaacaccattttccagctggatatatccgtcataacgtccttcctctgggaaatcccgctctgcaaggatataccactcgtcacttgcatggataaaatgaagtccaaactcgtcatacgccttcttctgatagctctcgatcagatcaatgacctcttccgcttcttctttatcaaaaagctccagtggataaagtccctccctgtacttggaaagtcctgccggaaccactgacacactccgcataaacggcagatacttcatcagatcttcgatagaacgcttcagctcatccttatcattaactcccttgcacagtacgatctgcccattcatctccacatgtccggcatacagatcatccaggaatttcagcttttctccggcgaaacgattgtggagcatcttgcagcgcagctccgggttcgttgtctgcacagaaatattgatcggcgcaagctgcatctcgataatacggtccacatctttctgcttcatattcgtcagggtaatataattgccctgcaggaaagacagacgggaatcatcatctttaaaatacaaggtctcacgcattcccggcggcatctggtcgataaaacagaaaatacacttgttgctgcaggaacggtagtcgctcatcagaccattttcaaattctacgccaaggtcatcatcatactctttctcgatctccagaagccattcttccccgtccggcttgcggatcagcacttctacatactcatccttgatcatgtaacgataatcaaaaacgtcctctattttctggttgtttattcgtagaaggacatctcccggctcgatctccatcgcctcggcaattgaatccgggtaaacctcacggatcaaatgtccctgatattcatttttcttactcaaattatattcctcccaaaatctggaatcggaaacaagatcttttccaggctagcttcctctttcatgtaatcctcatatttttatcataaacgactttttctgcaatgattacatactttttcatcataccataaaactgtaaatttcggtagggataaaattcagaagcctgaaacagaagcctgaaacaaaaattcacccataaattcaaacgatacctttcattctccaaccaaacaccggggaacgaaaccttttacggttccattccccggtgtccggtttgtatatatggttatctatatacaatttccatatgcttcaaaataaaatattctatttctgataccgcatgttacaagaaaggcttgcggtcttttattagaaacggctaaatcaagttcctcctgttcttacgcgtataagtattgtcgacttctatatagtagcatatctgcggtgtactttcctagtggtaaaaagagagattcttttgctactgaaaataccggtttgacagcttgcgaaatccaccgaaatgtatcgaaaaatgttttctttctccgaattccttttaattattcaaaataaattttcttctttgtaatatctgtttaaaatcagaaacaggatttcagtgattttttacagaaaatccgttcgattctacactgcgtccccacgctccgtcaccagctcatatccaacacttgctactcgtctccccatacatccgcgacattctgctgcctcttcaccggtacagatcttgttgtcataaagctcatactgcttccggttcttcactggagaaaggttcggcatcacaacattcgccccggcctgcagacctttttccctgccgagtggatccatcgtaccaagtgctgttgtcgccggaagaagtaccttcggcagcagaatccggatcacagcgagcaaaaacagtgtcatctccacacttcctgccggttcttttgaaaactgcgtatcgtggtgtgggataaacggtccgatccccaccatctccggctgcaattccttcagaaataccagatcctctgcaagatcctctgtcgtctgataaggtgaaccagccatcatgcccgcccccacctgataaccaagcttcttcagatcatacagacagtttttccggactgcgagactcattttctccggatgtagcttccggtaatgctcttcattcgccgtctcatgacgaagcaggtaacgatctgctccagcttcccgaaatctcttgtaactctcataagacttctctccgatagacaaagtcagtgcacattccggatatgcctccttgatttttttaataatcgccaccatccggtcatccgtataataagcatcttctccgccctgtagcacaaacgtccggaatccaagctcatacccattctcacagcatgccatgatctcatcctctgtcagacggtagcgctttgcattcgtattactcttgcggattccgcagtaatagcagtcattcttacaataattggtatattcgatcagccctctggtaaatacctttttcccataataaatctcccggatacggactgcttcctctttcagtctccggactgcctccggatcttctgcgcattttatcaattcgacaaaatccggtttcgtaaaatccggattttcgatgaatctttcgtaaactggtttcattctttccattctccctgcctggttttctgtatcttttctgaatttatgggcatttgtccatgaaattataaaatttattctatcacacttcgtcagccgcggcaatcactccatcaatgtctacgatttcgtcaagcggaatccggtccccgctctgcagtacgatttcattcagataagtgtcaatcctccggatacatccggactttttctatgtagtagtgttctgtataactgtaatgcccgaagtcctcatgtatcatgtactgaatattgagctgtaaaatatctttgatgatatgtccaatatccagtgtcggaaaccgtatcctcacataatcaaacagcatggtaacggcttgaccgtagaccgggcgcaggcgttgggcgaggaattttgccggaaacagtttcccggacaccaagccattgtctgcacccacccggacggacataaccacagcggaaatatccatgtgcatatcgttatcaattctctgcggatagcggaagttccgttcctgccttacatggacagaccggcggacacccgcgccgggtgcaagcaccgctgcacagacgcggcgatggaatacttcaaagccgaagtcatggagctgtgccaccgggaaaatctctatcaaatcgaccttttgcatggcagcaagaaccgcattaccgagcgcgagtattgggcgcagcggaaaggacaggcaaagctggacaaggaagctgccgccttaccagccgaggagcagccagccaagcccacgaagtttgaaacagacaaggaaaaattgcggcagaccatacgcgccgcgctgtcctctgccgccagctatgacgagttctccgccgttcttttgcagcagggcgtgaccgtcaaggagagccgggggcggctatcctatctcacgccggacaggacaaagcccattaccgcccgcaagctgggcgacgattttgaccgcaccgccgttcttgcccttttggaacagaatgcccacagaaccgccgagcagaccgcagccatacccgaatatccccgcagcataaaggagcgtttgcagggtaaaaaagctgtccaaaccgccccggaaaaggacggtattcagcgtatggttgaccgggcggcaaaacgagcggagggaaaaggcgtgggatatgaccgctgggcggcagtccacaatctgaaacaaatggcggctaccgttgccgcctacgggcagtacggctattcgccggaggaactggacgcagcccttgtatctgccaatgcggatttacaggacagcaccgccaagctgaaagccctggacgctgctatccgggagaaaaaagagcttcagacacaggtgattgcctatgccaagaccaagcctgcccgtgatggtctgaaagcacagaaaacggagaaagcccgcagcacctatcgggaacggtacgaaagcgattttatcatagcggacgcagccgcccgttatttccgggcgcatggcgtttccaagctgccaagtcataaggcgctgcaagcggaaatcgagcagcttaccgccgaaaagaacgcccactacaacgaataccgggagaaaaaagcccgcgtcaaggagctgcataccgtgaaaagcaatctttcccaaatcctgcaaggcgagaaagacagagagaaaacacacgaacaggagcgttaaaaaccgccccaaacgataccaaaacggggatatgccctgcaccctatccgcaatactacccacctttgaaacggggcatacagcgcaggaaatccccgaaaatgataccgagaaacaacatttttaccgacctatccgcttataccagcggaagcggcagaaaggagcgagaaatgccgcgcatgagcaaaaagcggcggttggaatggagctttttcctcaaccaccgaaaccgtattacttacaatgacctttgccggggctgcacacacggctgcaagcagagcttccgggcgattatcgtcctctgcccccggtatttctctaagagatggaaacacagggaggacaccgccaatggcagataaccgcaaatattactacctcaaactgaaagaaaacttcttcgacagcgattccattgtgctgttagaggacatgaaagacgggattttgtattccaatatcctcttgaagctgtacttaaaatcgctgaaaaatggcggcagattacagcttgacgagcatatcccctataccgcccagatgatagccacgctgacccgtcaccaaatcgggacggtggaacgggcgttagccatcttccagcagttagggcttgtggagcagcttgactgcgggctgctttatatgaccgacattgagctgatgatcggtcaatcctctaccgaagcggaacggaaacgcgccgcaaggcttgaaaacaaggcgcttttgccgccgcggacaaatggcggacatttgtccgacattcgtccaccagagatagagataaagaaagagatagatatagagttagaaaaagagggagagttaaagggacaagcccccgcccgccgctatggcagatacaacaatgtttttctttccgatacagaactggacgagctgaaagcggaactgcccgacaaatgggagtattatattgaccgcttatctactcatatagcgtccaaaggaacgaaataccgtagccatgcagccacgatatacaagtgggcgcaggaggacgaagccaagaaaccgccgaaaaaaggcatacccgattacacctttaaggagggcgagagtttatgactgaactttttaccgataccgttttgaatatgatgactactaccgcagagccggaggactacacaggcgaggacgggctgctttactgcggcaagtgccgcaccccgaaagaagcctacttcccggaaaagcaagccgccccgtttgggcgtgaccgccacccggcagaatgtgactgccagaaagccaagcgtttggagcgtgaaaccgccgaacagcgcagaaagcaccttgataccgtggaggacttgaaacgccagggatttaccaatcccaccatgcaggaatggactttcgccaatgacaacgggaaatgcccgcaaatggagattgcacacttctatgtggagcattgggaaatcatgcgcgaggaaaatatcggctatctgctatggggcaaggtcggcacaggaaaaagctattttgccgggtgtatcgctaatgccctcatggagcaggaagtcgctgtccgcatgacgaatttttctgcgattttgaatgacctgaccgccagctttggggggcgcaacgagtatatcgagcgtctttgccgatttcctctgcttatcattgatgattttggaatggagcgcggcacagagtacggtttagaacaggtctacaatgtgattgacagccgctaccgcagccgcaagcccctaatcgtcaccaccaatctgacattggacagcctgcaaaatccgctggacaccgcccatgcccggatttatgaccgccttttggaaatgtgcgcccctatcctctttacgggtgagaactttcgccgggaaacggcgcaagccaagctgaacaggctgaaaaagctaatgggggccccacaaagccgtaaggctttgcggggagaggaggagcaaggaaatgagcgtagttttccgctccagcgggaaacggagccgaatggactttgcgacgacgagatgaaatgaaaggagttgcctatggcagagaacaagcagaacaccaccccggaacgccgcccggactgcgtgacagagatccgcatgggcaacaccgtccttgtcgtttccggctttttcaagaaagataccaccgacaccgcagccgataagatgatgaaagtgctggaggcggaagccgccgcaggacacaaagcccagctttcgccttaacgctacaagccgcacagaaaaatcgtcattttaccgggcggtaaagaagcagaagccgctatacagacagccgccccatgtggtataatcgaaatacggaatagtggggctggctgtcggaaacggaggattttatgttaagacagaccacccagaaaatcactgccctttatccaagactatcccatgaggacgagctgcaaggcgagagcaattccatttccaaccagaagcgtattcttgaaacctatgcaaagcagaacggcttttccaatctgcgctggtacacggacgacggttattctggtgcgaactttcaaagacccggttttcaagccatgcttgcggacattgaagccggaaaagtcgggacagttatcgtaaaggatatgtcgaggttagggcgaaactacctgcaagtgggaatgtacacggaaatgattttcccacagaaaggtgtccgcttcatcgctatcaatgacggagtggacagcgcacagggcgacaatgactttgccccgctgcggaatatctttaacgaatggctggtgagagatacgagcaagaaaatcaaagcagtaaaacgctcaaaaggcatgagtggcaagcccatcacaagcaagcctgtgtatggctacctcatggacgaggacgaaaatttcattattgacgaggaagctgcacccgtagtcaagcagatatacaacctctgccttgccgggaacggtccgactaagatagcccgtatgctcacagagcagcaaatccccacgccggggacgctggaataccgtaggacgggcagcacccgccgctatcaccccggctatgagtgcaagtgggcgaccaataccgttgtgcatatccttgaaaaccgggaatacacaggctgtctggtaaacttcaagacagaaaagctctcttacaaagtcaagcacagtgtagaaaatcccctggaaaagcaagtgattttcgagaaccaccacgagcctatcatagacacccagacatgggaacgggtgcaggaacttcgcaagcagcgcaaacgccccaaccgctatgatgaagtgggcttgttctccggcatactgttctgtgcggactgcggcagtgtcatgtatcagcagcgataccagacggacaagcgcaagcaggactgttatatctgcggcaactacaagaaacgcacccatgactgtacggcgcactttatccgcaccgacctcttgaccgctggcgtactctccaatctgcggaaagtgaccagctatgcggcaaagcatgaagcccggtttatgaagctcttgattgagcagaacgaggacgggggcaagcgcaggaacgccgccaagaaaaaggaactggaagccgccgagaaacgcatagccgagttatccgctatcttcaagcgactgtatgaggacagcgtgaccgggcgcatatcagacgagcgtttcacggagctttcggcagactatgaagccgaacagcaggaattgaaagagcgtgttgccagaatacaggcggagctttctaaagcgcaggaagccaccgtaaacgcagaaaagtttatgaacattgtccgcaagcacatgaactttgaagaactgacccacaccctcttgcgtgagtttgtagagaaaatcgttgtgcatgagtgcagctatgacgagaacaagacccgtaggcaggacattgagatttattattcttttgttggcaaggtggacttgcccgaataaccgcccgacctgtccgacacaatgcgcaagtgccggataggaacggcaaaatttttacacttctactacttctttatcgaacatcagtaaaatcccagggaattaaacagttcatggctaattagttggaacaaaaaacgaaaggaaaagcacaatccagacggtatcagcggcaggctacaagaataaattgtgatttcacaagattggtgctataataagagaaaagtgatgatcttgtttgcgattgcggtcacttcgctgatctatgtaagagagtatccgaaggtgattccggtactttttgtaacgattggattcggactggtcgggttcctggatgattatctgaaagttgttcttcacagatcagatggactgatgccgatgcagaagatggcactccagatcgtgattacagcgatttttgcattttacatcgtgaaagtggcaaagataccgcttaccatgctgataccgttttcaggtgggaaatatctggacatcggctggtttgccattccggtactttttattgcagtgatcggtaccgtcaatggtgtgaattttacagatggactggacgggcttgcatccagtgtaacagttcttgtggcaaccttctttacagttgttgcgatcggaacaaagagtgggatcgaaccgattacctgtgcagtggtaggtgcgctgctgggattcttattattcaacgtttatccggcaagcgtatttatgggcgacaccggatcactggctcttgggggatttgttgcttcgacagcatacatgctccagatgccattattcattatcatcgtaggactgatctatctggtagaagttttatcagttatgatccaggtaacatattttaagaaaacaggcggaaagcgtttctttaaaatggcgccgatccaccatcattttgagctgtgtggatggagcgagacacgggtggttgcagtattttcaattgtaactgcaattctgtgcctggttgcactgctggcattataggaggcttacaaaaatggatttacaaggaaagaaagtgttggtattcggtgcggggatcagtgggatcggatcctgcggattactggaaaaagaaggggcagaggtaattctgtatgatggaaatgataaaaaagatgccgaggcaatgaaagcacagcttggtgagggaagcaaagtccgcgttgttctcggagcttttccggaagaggagatggaaagtcttgatctggttgtaatgagtccgggggtgccgactgatctgccggttgttctggctatgaaagaaaaaggaattcctgtctggggcgagattgagcttgcctatgtatgtggaaaaggagatgtgcttggaattaccggaaccaatgggaaaacgacaacaacctctcttttaggcgagattatgaaaaatgcccgtgacagcgtttttgttgtgggaaatatcggtacaccatatacgaatgccgcagcagataccagagaagattctgtgatcgtggcagagctttcaagcttccagctggagagtattcataccttccatccaaaggtaagcgcagttcttaatatcacaccggatcatctgaaccgccatcatacgatggaagcatatattcgtgcaaagatgaatattgcgaagaatcagacaccagaagatatctgcgttctcaattatgaagatgaagagacaagaaagatggcagatgaatttcaggcaagtgttctatttttcagcagtaagcataaactggaacagggcatttatcttgacggagaagacattgtatacaaaccggaaaaggagaaagaaggaacggtcatctgcaagaccggcgaattacagatccttggcgtccacaattatgagaatgttatggcagcggttgcaatggcagcagcttacggtgtagatctggatgtgatccgtaagtctgtacttgcatttaagggggttgagcatcgtattgaatatgtggcagagaagaacggggttgtctattacaatgactctaaaggaacgaatccggatgcggcgatcaagggaatccaggcaatgaaccgcccgacgatcctgatcggtggtggatatgataaacagtccgatttccatgaatggatccagagctttgatggaaaagtccgctatctggtactgatcggtgctacaaaagagcagattcagaaagaagcagcagagtgcggatttcatgactgtattttaaaagatactttcgaagaagcactcgatacctgtgtggagcttgcaagacccggagatgcagttctgctgtcaccggcatgtgcaagctggggaatgttcccgaactatgaagtgcgtggggaagaattcaaaaaatacgtgaatgcattataaaagaaataaaataatttcatataatctgtatcaaagggcgtgaaacaaagtggaggaaaaagggaaaaaggggcgtatggattacacgcttctgttgattgttgttctcctggttgtgatcggactggtgatcttatacagtaccagtgcatataacgggcaggtgaaatttcatgattccttttactatctgaaaaagcaggcgtttgcgacggtgcttggaattgtactgatgctgttcgtggcagggatggattaccacatctggcagagactggcagtatttggttatctggcagcagttgcactttcggttgcggtcatgttgtttggcagagaaattaacgggtccaaaagatggttagctttgggcccgttttcttttcagccatcagaatttgcgaaagttgcactgattctttttctggcggatcttgtgacgaagaacgtaaaaaaaatcggaaaaatgtggacactttgcaggatcatgttctggatccttccaatcgtgggacttgtgggagcgagtaatttaagcacggcgatcattattctgggaatcggtgtgatcctgatctttgttgcaagcccgaagtatgcgcaatttgccttgatgggaatcgcaggcgcctgctttatggggatttttcttgcccttgaaagctatcggctggaacggcttgctatctggagaaatccggaaaaatatgaaaagggttatcagaccctgcaggggctttacgcgattggatccggaggagtattcggagtcgggatcggaaacagtgtacagaagctgggatttgtacctgaggcacagaatgatatgatcttttcaattatttgtgaagagcttggactcgcaggtgctgggattatcgtttttctgtttctgcttctgatctggcgctttttcctgatcgcatccggaagcagggatctttttggtgcgctgatcgcgaccggagcgatggcacatatgatgattcaggttattttaaatattgcagttgtgacgaacacaattccgaatacggggattacacttccttttatcagttatggaggaacatcggtgatgtttcttttaattgaaatgggacttgtgctaagtgtgtcacaagtggtagactaaacaggagatatacaaaagacggaaggaggaagatgcctgatgggatgatacagaaagaaaggaaaaagagaatcataaagcaggctgccatgaaagccattctggtcattattttggtttgcatagctatgattacgtttcttttactctttcaagtgcggaaaatcgaagtatcaggaaatcagtatcttagcagacaggagattgcagactgggtgcaggatgataattggtcttccaattctctgtatgtgatgatcaggaaccacctgatgagtcacgagctgcttccggcaatggaagaggcaaatgtgacgatgaagaatccgtggactgtgaaggtgacaatcaaagagaagcgtgtggccggttatatcgtgtcaggtgatgaatgtatttattttgacaaggatggtatcgtacttgcaaagacaaaggagctgtgggatggaatcccgtgcattgaagggctggaagtaaagaaagtacagctttacaaagaacttccggtcagcaaggcgaacaaaaaagcatttgggaaccttctggatatgacgatgacactgaaaaaatgtgatctcgcgccggataagattgtttgttccggttcagatctgtatcttttttttggaaacaaatgtgtcaatgtcgggcacacgaatctggaagaacggatcatgcagatatcgccgatccttgagaagctgggagatcagggaggaaccctgtatctggaaaattttaacacagataatattacaattaccttcgaaaaagatgtgattccggaccttggaacataatctgtgtcaagtgaataaaaaaataggaaaatatacaaaattctattgatatttttcggaaaaaaatatattatagtcttatgtataactaagcgcatattgacatttagggtgtataatataataaggtgacgaaggaggagaaactcttgttagaaattaaaacaaatgaatcagaagcagcagctaaaataattgtagtcggtgtaggtggcggcggaaacaatgcagtcaaccgcatgatcgatgaacagattgcaggtgttgaatttatcgcaatcaatacagataaacaggctcttcagttatgtaaagctccgactcttatgcagatcggagacaagcttacaaagggtcttggtgcaggggctaaaccggagatcggtgaaaaagcagctgaggaaagtgccgaagagatccagtcagcactcaagggagctgatatggtatttgttacctgtggtatgggtggcggaacaggaacaggagcaactcctgttgttgcgcgtattgccaaagagcagggagcacttactgttggcgttgtaaccaagcctttcaaattcgaatccaagacaagaatgaacaacgctcttgccggaatcgaaaaattaaaagaaaatgtagatacacttatcgttatcccgaatgataagctgcttgaaattgtagacagaagaacaactatgccggaagcacttaagaaagctgatgaagttcttcagcagggtatccagggtatcacagacctgatcaatgtaccttcactgatcaaccttgactttgccgatgtacagacagttatgacagataaaggaattgctcatatcggtatcggacagggcaaaggtgatgacaaggctcttgaagcagttaagcaggcagttgccagccctctgcttgagacaaccatcgcaggtgcatctcacgttatcatcaacatttcaggtgacatcacgcttatggatgcgagtgatgcagcagaatatgtacaggatcttgcaggtgaagatgcaaacatcatcttcggtgcaatgtatgatgattctaagtcagatgaagcaactatcacagttatcgcaacaggtcttcacaatgtaggtggaacacagagcaagcttcagtcaagactggaacataaagcagctatgatgaacggtggatctggaatgggagcaagcaatatttcacgtccacagtttaatccgggagaatacagcaatgtagaaagaccggtatacggaggcagaccggtacagcagcagactacacaggtaccaccgcttcagagtgcaagaactccacagagcaaggtgaaagagcagtctatcaagattccggatttcttcaagaaataagaatgaaataacagggaagcagtaagaaattactgtttccctgttttttatagtttactgttcatagcgtaccatttcgcgtcgcagtctctgcataattttcttttcaagtcttgatatgtaagactttcaggattttaatctgattccatcgctgaatgtgtgggagaatatcgttcttccgctgggacttgataatcgcaaggtaaagccgcgggaagtggaagatattctcaaaaaaatcggactgcaggataagaaagatgcgatgccgtctgctttgtctggtggacagaaacagagaactgcgatagccagggcattggtgacaagaccggcgataattttggcggatgagccgacgggaaaccttgattcccagactgagctagaggttatgagcctattgaaaagctgcgtgtcggatttcgggcagacgcttatcatgattacccatgatgaaacgattgcccagatggcggatgaaatgattatcattgaagatggcaaggcggtgagaagataatgaagatgacgaccagagttgcatattgcaatatgcggcattataagagcaaaaacatactgattggaattgccattatcctgacaacattactgctgttcgtaatcccatcaatcggaaaagatatggtggaagtgaactttgcggtaatcaataagatttatccaacatggcatgccctttatcggaacgtggacgagagtacagttatgaaactggcggcacatcatgatgtgaaaacttacggactccgcagcgatgcggggtacatgaatctggaagatgcgacggtttccatgatgtatatggacagaacagggatggaactttataaagtgaagctgaaagaggggcaacttccgcagaaagaaaatgatattgtggtttcaaaaggaatactggaagcattaggacagaatgggaaaatcggtgacactatcacagtaccttatcagattctgaaagatgacggactggattatacgaaggagaaagactttcgaatctgtggttttttagcagataatgagagcagcaaagaacaaaaacaatatacatcattggtttcagaggcctttctgaaagcggagataccggtagaacaggtgaaatatcggtttttacttcaggtgaatggacagaaaggaaatacgactgcagattatacagagacgatacagaatattgccagacagttcgggatttccgaggatgacatgaatattaataaagagtatcttgcagcaaattatgtggatccggctacaattccggtgattgtaggaatcatgcttattgttgtattggcgggcattatcacaatttatagtgtttattatgtatctatgaaccagagggttcgggaatttggaaagttaaaggcaatcggggctacgaaacggcagcttagacaaatcgtactaagagagggaatgggagtggcgttgtttgccattccgataggacttttgatcggaacagttgctgtgaaagttgtacttctccagtttgtagaacatgcaaaggattcaaacgtacttataacagaggcatacaaggttgtagctaaaggagaagtccaactttattattggtggatttatctgttggcaattgcagtgactctgtgtacagtgtatctgtcactgatgaagcctatgcgtatggcggcgaaggtatcagaaatagaagctatgcgttaccagggaggcagtaagcgacagaaaagcagcaggaagggatatcaatttctgaatatcggacgactgaccaagagaaatcttgcagagaataaaaagaagagtactatcacgattgtatctatggccgttaccggaatatttgtcatgatggtagcaacggtgctgtcttgtgcaaatccgatggaaagtgcaaagagttcgattgtggggcaatatgagatttctccaattgtggaatccgggaataaagagcatcctgaatatgaatgggcggaggttcaaaagaataatccattaaatgaaggactaaagcagcagatagaggagcttgacggtgttgagcgggtagatgtgtttaccgcgttgaaggtatcaggaggaccttttgaagaaaaaattggaaccgaatttatcaatggagtgccggaagaatacgcagaagagctgaaaaaaggaatcactgaaggcaatgtcacatacgaggaattgaaatccggggataaagtgattctggaccgcgcgctacttcactggtatccagatattaaagtgggagataagctgaaactcaatattcatgatggagataatacctttcaaaaagagattgaagtggcagcaattggtgaatatggaacaggtctgacaaactataactgtcttatcatggcaaaagaaggggcagagaaacttaccataaataattcttccagctattttcaggtgattgcagataaggattatgatgaggcactggaagcatctctacaggctattgtggatggatcaggcagactgcagatgcgtacctggaagaatgagtacgatacatgggaaaatgccatacagatgactagaggtgcatgttatgcatttatcatcattctggcagcaatcagcattatgaacttgattaacacaatgatcaatagtgtccatgtgcgaaaaaaggagcttggcatgatgcaggcaatcggaatgtcggaccgtcagttgatgaagatgctccagttggaaggtatattctatacagtaggcactcttattatcagtatcggagtgggaagtcttgcaggatatccgttgtttttatatgcaaagcgtacaggaatgtttgatatcagcacataccattatccggtaacagcagctattattataattttaacattgtttgtgatacagatgttattggcaatattcattgcaaagtcagtaaggaaagattcattgatagagagaattcgtttcagtgagtaagaatataaatttctgatgtttaatgcagatactaatcaatgtcataataaaaagggggacttgatttctcaaatcccccagtgtataatgaactcaagaaaggtattcagatgcaaaatctgatgccctcagttaaattttatattctatgtataagtcatagcatccaaaactttcctagggtcgtggatgctatttcttattatgtcgatctatataagtcaaagccgcaaaaattaccaatagtaaagtcaatacttccattgtattcatgggcatcaccctccttggatactagagggcaaaatcgaaatgcatccgtctttccggttcagtaataccgaatcagtataacacgttaccgttttcagtacaataaggtaatggtctgaaaaatactttattctgtcaccttatgtagctgtatcgtgagtatttgctggactaattggtgctgtatatgaaaaaaagctatttaaaaataaggtggaagccttatatggtctgcttgatgatgcgggtgatgatgccgagggcaacattacgctcttcatcaatatgcgtcaccacaaaggatacctgatcctttttcccgactgtccggctgtcatagcaggagtgggcaatggcattgacaccgatggagagccggacaaagacggtgcctttatggatgtcttccacagttccggcgtattttccctgaatcttacattttttcatgttttccttgctggtgttgccttccacacttttgacatctgcgtggacaatgacctgctccggtgagtctgcccgcacatccaggatgcgtaccaggatgtgatcgcctacctggaagcgttctctggcatcacccatccagtcgaaggacaggtctctggcaagaatggaggtttccacaccgaaaatttctgcccggactaccttttccgcaacagcaatgactcttgcctgcacgatacggtcttcataaactttcggcattccggaagcatctttatccagatagaagatctggcgtttcttcagcatcgcttctttccggctggcgacaatgctgcgtgtcttcggatctaatcccttaatcagaaaatcaatctcacatccaagcatattgttgaggattttgttctgccgcagagcaagctccccataatcgtgtgcttcatcctgcatgagatggatcatcatctcagttactgggatgacagtacggaaatccttgtagtaaaccacggcaatgaggctgccgttttctgttttctcgataccgccaagcattccggttaagatccggcgggtacggtaggcattctggatctcatgccaggtaaggtctgaaatggactgggctgtttccagcttcgcatcggaatccagagttaaaataggtgtgttggttgtttcgtttggcatcatagtgtctcctttcaaattatgacatgatagaatctttatctaaaggaaccatgtctgtgtgatccgaatagttatctgctgagaagtcatccgggaaatcgtgatagccaggttcctgataaacgctttgctggtcaaagtgcggttcagcttttttctttttctgctttccataagaagcggtttttttcgggtgggaagcaggaatagttggagtgtacgtatattcttcactacatgcttcttttctccattccggaatatgttcggaagccttccggggaatgagtttttgggcatccgggtgcagggtgtaatcgtatttttctacctgcagtaccttctgaccacgcaggataatcagtgcagtatccagcgggagccgcaggatctcatccggagttaagagctttcgtttcccgatggatctggtctggcggtattccggtgtataatcggataccctccagctatttaattgtttggcttcgctgctgacaccaacggtcacatcaccggagcggttagagataaatgtagcagttacctcatccgtacagcctaaaaatagctgagtgtcgcagttcccgatgatttcctgccattggtttaagggataccggttctgcatctgaggcaggttttggaaaatgcaggaaatactgaggtttcgacttcggatcacggaaatctttttgttgagcgataggattgctcccgtattcgccagctcatcagccaggatatgtaccggaaccggcagttttccatcttccccataggtgtctgcataacggaccagtttgataaatacgaaggtcataaacagggaagaaagaaaatcaaaagtgctgtcttgatccgaagtgatgcagaagtatgcacatttttcttttcccggcagcgtcaggttgatctcatcataggaagtgatctggcggatcagcttgttctggaatacctatctgcaccgtatgtctccagagcatcaaacggatcaaccgcatttcctttggatttactcatcttctgaccattttcatcctgtacatgtccgagaacgattacgttctggtatggtgctttgttgaagatcagagttgaaattgccagcagagaatagaaccatcctcttgtctggtcaacggcttcagaaatgaactgagccgggaactgctgttcaaatacttctttattttcaaatggatagtgatgctgtgcaaacggcatggatccgctgtcgaaccagcagtcgataacttccggtacacggtgcatctgttttccacacttcggacacttgattgttacatcgtcaatatatggacggtgaagctcgatatcatccgggcagttgtctgacatggatttcagttcttcaatgcttccgaccgagtgctggcatccgcattcgcattcccagatattcagtggagttccccagtaacggttacggctgataccccagtcctggacattttcaagccagtcaccaaaacgtcctttaccaatgctttccggaatccagttgatagtattgttatttgcgatcaggtcatctttaacttctgtcatcttgatgaaccatgattctcttgcatagtagatcagtggagtatcacatctccagcagtgcggatagctgtgttcaaacttcggagcatcgaagagaagtccgcgcgcatccaggtctttgagtacttccggatctgctttctttacgaaaagtcctgcaaatggagttgtctcgcccatatcccctttctcatcaacgagctgtacgaatggaaggtcatatttgcgtcctactttcgcatcatcttcaccaaatgccggtgccagatgaacaacaccagtaccatctgtcagagttacataatcatcacaggtaacaaagaatgctttctttttctgttttgctgcgcagtcatatgcacactggtaaagtggttcatattctttgtattccagatctttccctttgtaagtttcaagaacttcgtatgccggtttgtcttcttctgcaaattttccaagaatggtatcaagcagagcgcaagccatataataagtatatccgtctgcacattttacttttgcataatcttcttccgggtttacgcagagtgcgatattagacggaagagtccaaggtgtggttgtccatgcaaggatgtatgcatcttcgtctttcactttgaaacgaacgatagcagaacgttctttgacgtccttatatccctgtgcaacttcctgtgctgaaagtggtgttccacaacgtggacaatacggaacgatcttaaatcctttgtaaaggagtcccttatcccagattttcttcagagcccaccattcagactcgataaagttattatcataagtaacatatggattttccatatctgcccagaaacctactgtagaagagaaatcttcccacattcctttgtatttccagacactttctttacatttattgataaatggttctacaccatatttttcaatctgatcttttccgtcaaggccgagcagcttttctacttccagctctaccggcagtccgtgagtatcccatcctgccttacgcggaaccatgtagcccttcattgtacggtatctcgggatcatatctttgattacacgggtaagaacgtgtccgatatgcggttttccatttgctgtcggaggtccatcgtagaaagtataagtttctccttctttacggttctccatacttttcttgaaaatatcttcttcattccagaatttttcaacttctttttctctgtctacaaacttcaggtctgtatccacttttttgtacttagccatgataagctcctttctgaatcaatgactttgtatgcatttttgggtatatagaaaaatgtgccccggcacgtagtgcccttaattttgcaggaagtttttggaatttcctgtaaaattaaaaaagactttcacccgtaaaaggacgaaagtctgtacatcgttaaccacctgttactgcataccagcatatgagtttcctgtaacgggggaaataaccgtcagaacttactcgccagattgctttcagttactgcaactcggaagtgatgttcagatctaccctacttgcaccggtcttccaccatctccggttcgctttacctttcaaataaaccttactgtcttcgtcaatgtcttttgatcttttttcaccatttctaggttattataataaagaaccccttgcttcgtcaaggggttctgcgggatttcgtaattctttccttatatttgactgaccagacgttaatctttgtcaacttctcttctgcgctttctgtttgtttccactttcttctttctcaagtgtttcagaacagccctccatacaataataagaatgagtactgctgcaatcacacagattacaaggattacctctcgtggtattgtactctgagcctgcttttgtgtttcactgtctgacttatcgccggacacctgtgcttcattttctgtgttatccttctgcagatattcatcacttaatgtcacagctgcttttccgaccgggttgccctgataagtataagttactgttccggtgctgctgttcgtgtcatcctgcgtaatttcgtaatccaggctttggaaatttacattttccggaagtacaacatatgcattcggatcaatttctttaaaatctgcggagtcttcataatccgcaatcgtatattttgcgaaattattaaatccatactccagtaaattgacggagtctgggtatacatttttcccatgtgtcttcaagacaacactgatcagctccagattatcatctgctgcacaagataccaacgtgttgagtgcttcatccgtataaccggtttttccggctattgtctttggataataatagtcgtttccctcgtaaaacatcagatcactctgctgaaaggttctcgcctgatttaccagattggttgcaccgatcgtatactgctgtgtctgggcaatcgtcttgaattcttcatgattttcaagcagttcctgcgtaataagtgccatatcacgtgccgtcgtataatggttctgcgcattcagcccattcggattttcaaaatcagaatttactgctcccagctcttttgcgcgttcattcatctttgcaataaagccatcatatcctaaaccacccacattttcagcaatcgcataagcaacttcatttgcagatgccatcagaagtgcgtgaagcgcatcatttaaagaaatttcctcccccgcgatcattccgatataagcatccccctctgctacacaatccacactattctgtgtaatcgtgatcttgtcatcaagattgccgttttccaatgcgacaagtgccgttaaaatctttgtaatactggcaggataagcctttccgtcaatgtttttcgcataaaggatcgcaccgctttttgcctccatgacaattccagcctctccgtaagtagccggtccttccggccagttctccagctcattgctggcaatcttcatatcatatgcctgctgtgttacttcatcgattttctgctgctgcagggctttaatttcttcttgattttttccggaagtttcttcctctgtcagattataattgctgaccgttgtatcaattggttcatttgctgacgtatcttctgcaaatgcggtcattccaagacttccaaccatcactgccaccagcgatgcacttaaaattttcttccatctcctcacagatcttctcctccaaattctttaatcttatccgataaatccccgatatctgttcaggcatgcgtaaatatcctgtttacggatctgtgccattgatacagaaagataacttcctttgcaaagggatgccagaccttgcttcttaatctgactccagagcttttccacgcaaagatcaacatcctgttccttccgttccatttcttccagcagattcttcaggcagtacgctaatgccgttgtctgttctgtatccaggatttgttctacatatttcagatccacattttctcttccaatagaaaatgaatctttaccaaactgttttatcttcacctgatctctcttcttttccatttttccggcctttaagcttctgtgatgatctttatcaaataagacagctacatcaaccggaacctttttctctccggtctcacttttttcatcaatcaccgttttcactttttctgtgatatcgtacgttcggtaattatccatctgcagcacatgatcagcaatgtaaaaataagatccagaacttccggccaccagaataatagaaattccctgcttttgatacaggttacctgcctgaagagtaaatggtgtaatcggttcctgttcaccggatacgacagcctgcatcagctcatctctgaccataaagttcgtcgcacaggtgtcttcatcgatcaaaagacattttgcacctgactgtaccgcttctaccacatttgcagcctgcgaagtcgaaccactggcatcctctgtagaaaaatttactgtatctttcttattcggcagatcattgataaacggtgaaatattgatatgggatacacatcttccgtcctcggcccggatcttcatcgcagtatccgaagtaatcacgtattctcttccatctccggcgacgtgattgtaaattccctgttcaagtgccttcagaagtgttgatttcccatgatatcctccacccacgatcaaagtaattccttccgggattcccattccttttattttaccccggtgtggaagttccatctctacttccatactttccggtgcttcaaaagcaattgcacctttcataggcttctgtgatacaccgctttctcttggcagtatagaaccatttgccacaaatgcaataagtctccgctttgtcagttctcttcttatataatgttgatcttccgcaagttctatacactttttcacttcctgctgattcaggttcttataatataaagatctgtcagctatttccggaagatactcaaacaaaatcttcctcagttcaaatgcattgatcgtccgtccatttgccggaaatccaacttcaaaccgtaccagaagatctccatccttaatttcaaatgcagtcctgtccagaacctcctgtccacagcggcttatcccaatcaatccacttttccccttgcaatgatccgcatggcagccgaaaatgcccacgcagaaggcaaatggatcggaatctgcggcgaactcggagcagacctcgaactgaccgaagaattcttaagcatgggattagacgaattatccgtatcccctgcaatggtacttccgctcagaaagaagatccgggaaaccaaataaaatctattcacagattttgtgataatcacatcaaaaacatcaaacaaacttacggggctaagcacgattcatcgtgcaacagccccgttctgcttttatttgttttttgcggaagctatttcacacccgtcagaaaacagccaaatttgcgttccctttttcttaacctttttttgactttcccctcattctctgctaggataaaatcagaacttaaaactcgtctccgggggaataagatatgtacagagtaagcaaaattttgaataataatggcgtgatcgcaatcaatacagaggataaccaggaatacgtccttctcggtaaaggaattggctttggaaagaaggtcagtcagcgttttgaagtgacagaagatacagcaacttaccgcctgaccgaacagacagacagaggatctgccaaatctctggtgcaggagatggatccggaatttctggaaatcgcagatgaggtgatccgggaagcagaaaaagtttttgggaaagtagaccgccggatcatgatcccgctggcagatcatatctcctttgctgtttcgcgaatccggaatcaggagcagatcagcaatccactgacagatgatatcagagtactttttcataatgaatttcaagcagcatccgtgctcagagatattttgcagaagagaatgcagatcacgatcgatgagcatgaaatcggatacgtggcacttcacattcattcagcaatcgaggatgaaaaagtgtctgtggcaatgcagacggcccgtgcagtgagagaatgtattgagatgatcgaaaaagaaacaggaaaaaagatcgatgtgatctcgctttcctataatcgtctgatgaaccatatcaaatatatggtagcacgtgctatgacgggggaggatcttcgtatcaatatgaatgaatatatagaatccaaatttccggaagcgtatatgactgcaaaaaaagtctgcgatatgctcggaaagagtattggaaaagaacttgatgagatggaaatcgggtatctggcaatgcatatcgaacgaatctacagtgaagaaataaaggcataacagaggaaccggcttttgccaaaagattgacactacggggaaacaaatggtataatcggaccaaagtttgaacattagtctaaggagaaaggttggtacggtaatggctacaaaagaacagatggaaaaggtgaagaatattgttgtgaaactccgttatctggagtgtatggataatatcatttactatgacagatggaataactgcccgaaggacggatttgattatgaagggaaagtcggagcatatctgacagagctttctaatgagaaactgacgagcaaagagacaaaagaactggtagagtcactggaaagagagacagcttttgattcagatacagacaaaggtatggtacgttatctgatcggaaagtataaagaagcagtacagattccggcaagcctgcagggagaattgaatcaggcaaatgcagatggacagctggcatggggaaaatgctatgagacagatgattttgaaagctttaagccggtactgaaaaaacagtttgatttacaggagaagatagcaacagcgatcaatccggatgaaaaaccatatcaggttctggtgaaccggtttgataaggattatcgtctggaagagattgatgcaattttggcaaaaatcaaagatgctgtctgcgaaattttaaatgcggtaagagaagaacagagtaagattgatgattccattctggaatgtgaagcagatcatgatacagtacttcgtattgtgaagaaagcgcaggagatcctgggacttgataaagataagagtactttatttgagatccatcatccggtatgtgtctgcaccggacctcgtgattccagaccatccacaaactgtgatgagctgatccatgcgattctggcagtggttcatgagaccggacacggactctataattataatgcgaacgatgaggtcgcagaaagcggactctggggcggaattgaaggtgcaatgcatgaatcccagtccagattctacgagaatcatgtaggaagaaccagagaattctgggagaacctgtacccatatctgcagaatgaagtgccaaaatacaaagagatttctctggatacattccttgcggcactcaataaagtaaaaccgggactgatccgtctgaaagcggatgagcttacaaataccctgcatatcatcatccgttacgaaattgaaaaagaatatttcgatggaaaactgacagtggatacaattgaagaagcatggaacagaaaatatcaggaatatctgggatttactccaaagaatcatcaggaaggaatcctgcaggatgtgcactgggcttcaggatgtgtaggatattttcagggatatgcacttggagatgcttacgcagcacagtttgctcataagcttcttgctgattgcccggatgcatttgaaaagctgggaaaaggagattcatctgtaattggaaactggttaaaagaacatattcaccagtacggacagacctattctgcacgcgagatgctcaaaaaagcaacaggagaagagctgaataccggttattatattgaatatctgaaagaaaaatatttacactaagcgcagagggcaggaggattgaccaatgaataaagaattttacgcaggaaatcgtaagagcctgtatcagaaacttgaagcgggatctttggtggttgtattcagcggacatgcaccgatcaagaccaatgatgagaattatccgttttttacaaatcgtaactttttgtatctgacaggaattgagcaggaaaatattgtactgatggcttatgtcggagagggaacaattgaagaaactctgtatcttcttccaccggatgcatttgcagaacgctggaccggaagacgtataaaagaagaggaagcagaagaactttccggaattacgaattacaaatatgtggcagcattccggaatgatctttccagacaattattttctggcaatgttaagaaagtttatcttgattttgacaaggtttatgaaaatacgccggcagtagaagcataccgccttggcaagtatctgaaagaacatgctccgtttgttggacttggcaaccttcatccgatcatgaaacagcttcgcctgatcaagaaaccatgtgagattgaggcaatgaagaaagcggaaacgatcacaaaggccggaatcgaagcaatgatgaaaacatctaaaccgggaatgtacgaataccagtataaagcagaatttgattatgcactggctcagaggggagtgctttcaccaggatttccgtctatcatttcatcaggaaagaacaactttaaaattcattactatgattatcgcggacaggcccaggatggagatatgatcctgaatgacgttggtgctgtatgggattatgagatcaacgatgtatccagggcatttccgtgcaatggaagatttaatgaccgtcagaaattgctttatgagtgcatttacaatacttcagaatatatgttcagtacactgaaaccgggtgtaccgcttctggatgtggataagatcatccgtaaatatacatttgaacagttaaaagaagcaggagtatgcaaaaattttgaagatattgggacttacatgtggcacggtggagcacatcatgttggatttgatgtacatgacgtggtagaaggaagcggacttgctgtaccgggtgttgtattctgtgtagatatcggtgtttaccatgaagaatggggcattggattccgtctggaagataattgcctgatcacagaagacggatgtgaaaatctgtcaagagcaattccgagacagatcgatgagattgaagcatttatgggacgcagataaatagaaaacagggaaagggggagctgtatagaaaattacggttcccttttcctgaaatatggagagccaggatatggaaaatagaaaatcacggaaaagtacatttctttatgtaatactattaactttatgtgtaccacttgcatatgtatatcttattcttgttacgggactgctggataaaatacaggaggggcatatcggattaacgttgatgattgtgtttcttccactgtttttttattggggacttgtggcagttgtgggaatcataaatattggacagtcatttaagatatacaaaacgggaaatccgattgaatgcgtgaaccgcatgctgatccataaatatgggctggttgtctttttctgtgtaaattttctggttctgttcatttattattttttcataagtatggcagtgctggtaggaagccggggagccgcgataatctttgctccggtattgctgccgtggctgattgtagcagtcgttttttcggttggtgcaacatggcttgctattttaccgggaagcttttatgggatccaggtgatccgtatgacctataaaagtgggaaaatagggtttgccgaagcagttgtacatacggtattccagtttttctttctgtttgatgtgttggatgcaatgtatcttgcaacggaaaaatggggaagagggaaaaagagttctgcaattattgggtgtgtgtatctgtttgcggtttttgcaaccatatatctgataattaaaatgaaatcaatgttttaaaatacaagcagttgtatcagagtgttggtacggttgctttttgtaaatgtgaaatgaaaaaggaaatggaaggggatgttcagccgcgccattcgcaaaagcatgttgaattgatgtcagaatattctgaattgcgcaaaatataaaaacaacattgacaattccggaaaggcgtggtaagataccatatgttcgctggtcgagacagagactaaggagtggcatgcagaggcagagcggatgaaaaatgattgtagtcgcaatgctctctcccgaggaaaacgtaatgattgtgtgaggattctgtctggtaaggtaaaaaatatctgaaattttgatattttttcgttcgaaatatagtggaacattataacacatagatattaattttttaacttgccttttgagagaggagaaaattcttttttcaaagggctttttctatttatgcggatattcgtaactacaagataaagcccaaatttcatatactctaagtacattgaaaaatttgcttccaagtacaaattatacttgccgataaaagaagaactgaaagcggagattgaaactcaaaaggcaatgttttatcttcagcagcaggacaagcgaagcaaatagagaattaactgtaaaaagttagagctccatttgtgtgttccatgggcgcgctctagcaggtgcaagactagaatacaaaaaatagatttgcgaatgaaaagtgtgctatagttataaaagataaatcagaagaagtcaggaggaagaatgcaatgaaagacgaaaaatctaaaataacagcagttgccattgaaaaaatgattgatttttatcaggggaatttgagagatatcgaacatttcctgaaagtatgggcgtatgcaaagacgataggggagcaggaaagtgtggatgaaaacacacagggaattcttgaacttgcagctgtggtgcatgatatatcctgtccgctttgccgtgaaaaatatggaaacacaaatggtaaaaatcaggaacttgaaagtgaaccgctggtaaaggagttttttgaagaaatgcctgtatcagaacagaaagtggagcgtattatctggctggtcacacatcatcatacatacaccaatatagatgggattgattatcagattttaatagaggcagattttcttgtaaatgcaagtgagagtaatttttcaaaaatgtcgattgaaaatgcgaaatcccgtatttttaagacggcagcgggatgcagattgttggaatcaatatttttaagagaagaataataaaaagcattatattggagaataatttatggcacaatcaaaacaggatgaactatacaaagcactgcaacagaaaggctatccggacagcctttgcagggaaattgcttataaacagatgaacacagattatacagcaacaagaatgctcggctatctgtaccgcatatcagatccgcgaccggaagatgtggtggatgagatgctggcaattctaagcgatcggaacgcaattatccagaaaaaagaatcggaacatgcgcaggcaacgatcaataaggtgtatcgcgaaggtctgtaaaaggtgatcagattaaatatacggatgaaaacaggggaaaagaaatgctgaacgtaatagaaatcaaagactttaatgcgccggaattggatatttatgccaggtgcacagaagcacggcttctgaataaagatcacccagaagagggaatgttcattgcggaaagtccgaaggtgatcggcagagcgttggatgcaggttatgagccattgtctgttcttgttgaaaagaagcagatggaagagaatgaagaaacaatccagattatgaacagatttgatgatacgaaagtatcgatttttacagcggattttgaggtgctgactaaattgacaggcttcaaactgaccagaggaatgctttgcgcaatgagacggaaaccgcttcgaaaatttcaggatctgtgtgatgggataaacagaatcgcgattcttgaaaatgtgcagaatccgacaaatgtaggagcaattttccggtctgcagcggctcttaatatggaggcggtacttctgagtccgggatgcagtgatccgctttacagacgggcttccagggtgagtatgggaaccgtatttcagattccgtggacatttatccgggatagcaatgaaatgcggtgcaagcgggaagtaatctggccaaaacaggtgattgcagaattgaaaaagcttggctataagacggcagcacttgcgctgactgatgattcggtcagaatcgatgattcggaactgatgaaggaagaaaagttggcagttattcttggaaatgaaggtgaaggactggaaaacgagacaatagcgctatgtgattatacggttaaaattccgatgacacatggcgttgattcgctgaatgtggcagcggcgagtgcggtggcattctggcagcttgggaaaataattctgtaatggtaaccgtattgtatcagatgacacggaggagggaaaagatttgacagaacgttttcggaagattgatgcagcaatcgtagagtcgaatgcaaaaacgtagaatttacacctttggaagatatgatatttttacagtactgctgtcagaaggagatacaaccataacattattgtgtgaaagagtaaattccaccgcccagttttgtaaattgttgaaagaaatatattgttatatgattacgtaagtgatatacttaagcataagagaaccgtgtaaaattacagtttgctttttgcacggttttctttatactagatggttagttgaaactaacacaatgaaagtatgaaagattatagaataacatatattaggtattaggcaatataatcaataagctatagaactaatactataccgctgaagataattatttttgccaatgaattttttcgagcatatatggaaggaaaatataatgcgaataaatatttttgaaggtatactgattccgtttgttggaacaacgctaggtgcagcatgcgtgttttttatgagaaaaacacttagcaagttactgcaacgtgcacttgcagggtttgcagcaggtataatggttgcggcttcaatctggagtcttctgattccggcaattaaacaatctgaaaatatgggaactttatcgtttgttcctgcagttgctgggttctggattggtatattgtttttactcgcacttgatcatttgattccgcatcttcatgttggaagtgatcaggcagagggaccgaaaagcaaacttggccgtactacgatgatggtgttggcagttacattacataacatccctgaaggtatggcagttggtgtaatgtatgctggatttcttgctgaaaatgcacagattacagcaacaagtgcacttgctttatcacttggaattgctatccagaattttccagaaggagcgattatatccatgccgcttagggcagagggtgaaagtaagagaaaggcatttctgggaggtgtactttcaggagtcgttgaaccgattggagcagtaatgacgattcttgtcgcacagctggtaatcccggcattaccatatttactcagctttgcagcaggagccatgttatatgtcgtggttgaagaactaattccggaaatgtctcagggacagaactcgaatatcggtacgcttttctttgcacttggatttagtttgatgatgatcttggatgtggcactggggtaagaggagaggaatgattcttatgagaatattgatttatggtgcgggtgtgatcggctccttgtatgcagctttatttgcagaagccggttatgatacaagtatttatgccagaggaaaaagatttgaggctttaagaaataatggattgctatataagaaaaatcaggaaataaatccgaaagaactaagcagttttcagagatattgaggcatgctcatataccataccagaaagtaacggatatgcatctatggcagctttgtcatcttgctatggtggtaccgattgcggatgcgtattatgaatcagacgatccggagaaagtggaaaaagaatggaaaattatgaggaaaacagcggaaaggctgaaaagaaattttaactttttgcgaaaacaaaagggtaaactgtcaccatggaaaatgaatatttttcgctttttgccattgtcatttctgacgattatgctggcagttacatttggaagtagttttggagataaatttatgtatcaacatgctatgaaggcaccagatgaaatgagggaattgcataagcagttttatgcttatatgaaaaaaatgaagaaatgcggatgcaaggcgaaaaaggcacagtgattggagaaaaaagcatgaaaaatgaagaatataaaaaattgtcaattaaagagtttacaaaagcagcaggaagatatgaaagtagctatgctggtatttacgaaatgtgcaagaaagattatccggatattctggaagaattagagaaggagccatttagagatttattagatgcaggctgtgggcctgctccgatgatttctttattagcagaaaaatatccagaccgacattatacaggactggatctgactcctgccatgattgaacaggcagaaaagaaaaatatttcaaatgcaacatttgttgtaggagactgtgagaactttccttttgaaaaggattcatttgatgcaattatttgttctatgagcttccatcattatccggatccacaggcattttttgacagtgtgaaaagatgtcttcgcccaaatggaagattgatactgagagatgtgaccagtgacaataaagtattggtatggctaatgaatacattggaaatgccgttggcaaatatatgcggacatggagatgtccaagtgccaacaagagatgtggtcataaaatgttgcaaaaaagcaggattaaaagtagaaaaatttgaaattcgtaaaggtatgcgaatgcattgtgttgtgagaaaacctatgggaaaggcgataggaaatgaaagataagtatcttagggaaacacgaatggttgatttttctaatccggcaattcaaaaacttattcaaaatatgaaatggaaggaaatgggtgaatttgaaaggattaaggcaatctacaactatgtaagagatgatgttttatttggatataatattgatgacggaatttcagcttcaaaagtacttgcagatggttatggacaatgtaatacaaaaggaactttatttatggcacttttacgtgcctgcaatattccatgcagagtacagtctttgtagaactgctccatgcctttgataccagaccgccgataaaaagtgaggtggatttggaatgatgaaatctgtcacaaaagaaaaggtattccatctggaaaatgatctggatgtctggatcattcaaatagcattggcagaaagtgtagctgcacgattgcggaaacatggatttaaatgcaaaacagtagaaattacagttcgagataatggattgtatagtttttccagacagatacatttacgacagccaacgaatattacaaacgagattgtaactgcagcatttcagctatttaaagataattataaatgggaacatcccattagaagcctgggaatccgagctgcggatcttgtgttagatgatattcccgtgcagttggatttatttggaaatcaggagaaaaaggaaaagttagagaagctggatcgtactgtagatgagatcagacgacggtttggttatttcagtatacagcgagcggcaatgtatcaagataaagtcttatcccacttagacgctggtacgcacacgatccatccacacagttattttcatgggtaattggagggatagatttgaaaaaagcattaaccagaaaacagaaagaaagttatcaatgtattttgaattatatgaaggagcatggatacccgccgacagtccgggaatttggagagttgatcggggtgaaatcaacatcatctgctttttccagaatcaagcagttggagcaaaatggatatatccgcagaatcccggcatcgccaagagcaatcgagattttatagtgaggtgtcggtatgaacaaagtatatgtagatgtagtggcagagtttcggaaagacgggcagctggttcccatattttttacatgggaggatggaagaaaatatagtattgacagaattttgaaaatcgagcgatgcgccagcagaaaggcaggcggtgtaggaatgatgtacacctgtatgatacaggggcaggaaagccacttgttttacgaagtggataaatggtttatggagagaaaaacagcataaggagagattggtatagacgatattatttggattattaaccggcagggatagtcactttccctttatattcctgtaggttttacataagaagatggattccggtcagcaaagacagctcccacaatgccttttggatatccgcttctgcaagttgtagtaagtaattgcttcccatcaaaatcatggggaaagcgaactggtctgaaagaccgccagttagtgtgatgatgataaggagattttgaaactgatgacagacagagattatgcaattaaatcaatgaaagaaattaccttccagatggcaagtcatgcacaggattatctggaagttacaatcgaaagacattatactgatattaaagaattgatgacaagctatcagaaattgattttggaaaatcagattgtgttagaagaactggatatggaatgccaggagaaaatcaatgaagatatggcatatgtattgagttatctgagcatttataacaaccagctgaatgtgccaaagatgcaccgggagatgaataatctgatgattatttatggattgtcggacatgatctatcggggaatgactttggtgaagttctatgcaccgaatggtgtgatgctcagtgaaatccttcattcctgtttttgcagtcattataataagacagatgtggaagtacaacaggagttgggaataggcaggacttctttttataaaatgaagaagcaggcacttgggtatttaggattttatttttatgagatcgtggtaccgcaggcaaaggataaaagatttaaaccgtcactgggcgttgaggaagagtaggtgaataatatgagatacgaagattcgatgaaaggtgtagctgctcagataatcaaagaacagcagcgagtcagtaaaattaaaaacaatccagaagagttccattggcatgacgaatatgcaacgttgaatttctttcggtttatctgtaaaaatatcggtaacttgggaaatggagaaattgaaaaaatggtcacacgcttaaagagcatagatcagaaagcagtggaaaaccatgtgaatggtgctgtttgggcatttgattatgataagatgttctgtgtattgatggaaaatgaaatatgccaaaaggtgtgtgaaaagaataaatataatagttggacgaagctgattggaaattattgttttcaagtggtgtaggataaaatagtggcttgtgaaaagctggttttgatgttaagatgaaattgggataggagacatttaggaacctgttctgacacagcaaagaatggaggcgagaatggacgtgacgaaagcagaaaccgtgaaaacagaagaattggaaacacgttacgaaagatacaagggtatcttaaaagaccttaccatcatgagcgatgtgtttatgcggaatgtatttaagaaacgtgaatgcacagaatatgttctgcaggtaattatggataaaaaggatctgaaagtgattgatcaggttcttcaaaaggactataagaatttacagggacgttcagctattctggactgtgttgccagagactctgaaggcaagcagatggatgtagaaatccaacaggataatgaaggggcatctccaaaacgagcaagatatcatagtggtttaatggatatgaacacattaaatccgggacaggattttgatgaccttccggaaagctacgtgatttttattaccagagatgatgcacttggctatggacttccgatttatcatgtagacagaaaaatcgaagaagtcagtgagaattttaaagatgaagctcatattatttatgtaaattctaagaaacaagaggatacagaattaggcagactgatgcatgatcttcactgtaagaatgcagaagatatgcacagtaagatacttgctgacagagtatacgaattgaaggaaacacagaaaggggtggaattcatgtgccgtgagatggaacagatttatagtgaaggtattgaaagtggtgagctgaaaaaagcaaaagcctcagcattatccatggctgcggatggaatgaaagttgataaaatagcccactatcttaatgtaagtgctcaaatggtacagaaatggattgacgagagcatgagtgttgcacattaacaaatgataaattttaatggagctaccaggggatactaattcttctggtggcttttttgtgtgttgcatgtataaaaaagtgaaatctagttctatagaactataacttgatttgcggattctgtatctttcaattatccatcagtatactaattttagaccgaattatcgttctgaaggaggtgctatgatggatttaaaagcggttggtcagcgaatcaaagcagcaagagaagcaaaaaatcttacacaggaagaactggcggcgctggtaaatttaagtacaacacatgtcagtgtgatagaaagaggactgaaagtaacaaagttggatacctttgtagcaattgccaatgcacttgatgtatcggctgatgcgctactgatagatgttgtgacacattctgtcacaggtgttactaatgaattatctgatatgatagggaaattgccaaaggacgagcagaaaagaattttaaatgctgtcagagctttggtagactaatgaaataggcattgaaatcgaagggcattaagctcttctttttttgttcttttttatggcttcatttgcgaaagtatcttttttcatagtgagaatcatgatatagtagttctaaagaactataaataattctttgaaaccggagggcgggtaaatgagagaaaaaactatttatgagaaaattgcagaaaagtacaacacaacaccagaagaagtacgcagagaaatgcagatagccatagatgcaggatttgataatcctaatccggctgtgcaggaagaatggaagaaaatgacacttaaaggagaaagacctacaccggaagaagtaatcaattacgcagtaaaaaaactaaaaggaaaataaaaatatgaagaaaaagataattgcattgatttcaggagcagtgatcttgataattgctgcaggaagtatttatgggaaatctgaatctggtcataaggaaggcgaaccggatgtagttggaacattttccgtaaatcgagatgaaaatattacagtggttgctaaccggggacatatcggggataaagaagcttttgcaagagaacttttgcagatgtacaaggatgattcattttattcgacaaaattctccacagacaggggatatgcgacgagccttgatatgaacatctatttatggaaagaggatattgaagatggggaatcggtaatgacagccgaatatagacctgtagaatacggaaaggactatgatgtagtcaatcatcctgataaatttcaactatatatagatggaaaagaagtagaagaataacacgatgaactttttatactgaaatatgtacgattccaataatgatatgaacttatgggaatatattgcggatactttgtgaactttatcctgatacaatgattatgctgatgaaagaaggcatagataactgaatacaagaaagagacgaaagcctcagtagttaagaaaaaactactggggctttttttcgtgcctgaatttctcagccaataactgcgggcgtatcccggcaggataaaggcggagcaggcatgatcctaaacagaggtccgccttctggatttgaaacgagcaacaagatttcaaattcaggaggaacggatatgtatattgaacacccatatttttacgaaggaacaagcaccagctttggtgtgtataagaactttaccgccattgacacccacacggtacatgaaaaagaaatcattcagctaagattgaacgataccaacggtattgagaattttgtcaagaactttgcgaaagcctattattcatgggataccagcaaggaagccattgaagcaaggacagcggaaatcagtaaataccttaccaaagaattgcaggacttgaacgccgataccatcagaacggatatcccaaccagtgcgaccgttacaaatgtgctggtctggaatgtaaagcagtctggaacggacgattttaccgttgcctacgaagtagatcagcaggtaaaagagggcgaacagacacaggcagtcacaaaaaactatactgtgaccgttcatgtggataaggacggtgcaatggtcattacccagaatcctacccttgctccggcaatgcagaaatcaaagtatgagccgaaagtacaggaagccgatgtcagtgtcagctccgacacagtcaaggacgctaccgctttcttggaaacattctttaagctctatccaacagctacggaaaaagaacttgcctattatgtcaaagacggcgtgcttgctcctgtatccggcgattatgtattttcagaactggtaaatcctgtctttaccaaagatggcgataacctcaaggtcagtgtgtctgtgaagtatctggataacaagtcgaaaatgacgcaaatctcacagtatgagcttgtgttacataaggacgataactggaagattgtagaataaataatcaaggcttgcgtcataaaccgtatagtatgctccgcaagcctcatttcggtatgatttgcaagctgattaatatagttgttacatttcgtttaagagattataataattaaaacagctaaaatctatcaatttttaacagtagtatgtggacatagttgataaaaaattgctttttcaatgataagatatatttctaaggaggaacgagatatggcacagagcattttgattgtagacgacgaaagagatattgtatcaatgctaaatcaatatttttgcaaaattggttatgtagtatacacagcaattaacggaaaagaagcactgaatgcaatcacaaaacatccagatattattttattagatataaatatgccagatatgaatggttttacaatttgtgaaaaaatcaggaattttgtgtcctgtcctattatttttttaacagctcggattgaggactgtgataaaatcaaaggatttgctgtcggtggtgacgactatgttgtaaagcctttctccgttgatgaattagaagccagagttgctgcacatttgcggagagaaaaaagacatggttcgtccgcaatagttcagttcgataataatatagtaattgattattcatcacgagttgttttttatagaaatgctgaaataaattttacgaagaaagagtttgatattattgaatttctttcacaaaacaaggggattatttttgatcgtgagacaatttatgaaaaagtatggggcttagatggttctggcgacaattctgttattacagaacatatacgccggataagaacaaaattcctttctataggcgacaatccttatatagaaactgtctgggggtgcggatataaatggaaaaagtaaggcgaaaaaattcaaggcattatattgacaacatgagtattaaaaattcgtttgttttttatgctcttatttccttagtgattggtattgtaataggtgttatatctattactcttgtagatgattacagaataaaccttaactataaatatgaggacatgacaacaaggtatgatatacctgaaaatggttcatttacagcgaaatataacaaagaccaaacagaatacacaatatataatgcaagtgaaaaggaagtatgtaattttgttgtagactatcaaaaggaacgtccagtacaagaatatatttatcctaatcatgtttcttacattgaagtttcaccaaagtttactaaacatgatagaattgtggattctgctctaggtgtggttaatattgtcaccattcctattgttctttcaattagcatgattctttgtgtgactatctttgtaaaccgaaaattagtaagacccataaagttactgacgaatgcatacagaaaagtcgaaaacaacgaactggattttacgttgccttacccttataaagacgagatggggaggctgtgtcttgcatttgagaagatgaaaaattgtttatatcaaaacaaccaaaaaatgatacggcaatttactgaacaaaggagattaaatgctgctttttcacatgatttacgcacgcctttaacaatactaaaaggacataccacaatgttgttatcatttattcccaaaggattagtttctcaacaggaggtactcgacgaattatcaacagtacgcaacaatgtggaacggcttgaaaaatacgttagtgctatgacaaacttataccgtttagaagatatagaaatcgaaaaagaaaacataaactttgacttcttattaaaaaccttatcaaatacaacggaaatgctctgttctgatatagaatatacgattaaaacaaattgtaataaacagcaaactctatttatcaatcttgaaattatcatacaaatttatgaaaacctgttgtctaatagcattagatatgctaagtcgatgatagctattgatataaataaacaggaggaatttttattgattacggtctctgacgatggctgtggtttcaaaagtacggatatagaacgtgtaacattaccattttataaaacatcgcaagatactacgtctgaacatctaggtctgggattaaacatttgtaaaatattatgtgaaaggcatggaggtacaataaaaatttcaaataatcataaggggggagcctgtgttacagcttgtataaaaattgcatatgttgatgaaaaatagacattttccccatataattgcattaagcacttataaaggaggtttcgattatgaaaaaaattatctgtattattttaataactgtcacaagcattttgtccgggtgcaattcaacatcagatgaagaaataatatcatcacaggatttcaaagagaattatgaggtttcgtcctatggaactgaggaaaaaattaatactttatcagatgttgagcttacatcaagtgaaaaagagtattctgacttagaaaacgcaaaattttttttagaaaataactccaacaaagagtatcattattctaaagcctattttgaaattgaagcggagcaatcagaaacatggtatcaattaactcaactttatgacccatcaaaagataacgaagatgatgcagttataaatcccaccgaaagattaagtttaccatttgatatttcctcggtttatggcgaactcccatcagggcactatagaataatagtaagtatttcttatttcgaatcccctaaagattgggattatgacacttattatttggcatgtgaatttacattaaaatagtatatcagaaaggaaacaaatgggaacagcaaaatggatatactgtcctatatgcaagaataaaacaagaacaaaaatcagaacggatactaagttgataaattttccactgtattgtccaaaatgcaaacaggaaaacctaattaatgccagcaaattaaaaataacagtaatcaaagagccagacacttagatgcagagccgataattcagaggatttcatatctcatagattatcggctcatttttattacctatcaccatatcccgtatgattggcaggcaaataaaaatggaggaactaatcttcccccacttcctttgatttgatgataccagcagcgacgctctccatgacaaccatatctttgtcgtcgaaagtatcaagctgttgttccaactgtctgcggcgagtgctttttactttgtcactggtcggcaggaaaatttcatcaacagacacattaagtagagttacaaggtcataaaacacctgtaaacttgggtgctgccctttattctcaatattcgtcagatagcgtgggtcaatttcaatttttgctcccacctgttcacgggtcagaccttgtttcatccttgccgctttgatggcaagaccaaaggctctgaaatcgtatttatcttctgttttacgcataattaatcacctcactacattttactgttcctaaagaatttgtaacaggtacagtaaaacgtattgcaaggtttatcagttcctatgaacaggtaaataacaatatatgctgcttggcggtaaaaaaaaaccgttgtcagcagtaatgcttttatacgtccttttagatagaacgacggttcatacagccgccgttttatttttgtccaacggtggacaaactactggttggttttgttttagcggcttcaggaggtagccgcatggaatgcctatacattcaacaacattcgaccattggtagcttgttaaaaaaatccgtttaacttttgcggattatatcgctcttgtatatggtttttcacatcacatagcaggaacaatttataaggcacaagaacagcacgtcagtattgctcttgtgcttttttgctactttaaaaaattttttgatttttttctgattcgggttacaaatcacccctccgtgttgagtgttagtgcggaaagaggtaaaaagccttttcgctttagcaacttcgactagagatgagcaaaacacattaattcaaaagtaggacgtggcagttagtttccataaagtttgaagttacgattttagattccaacgccggatttaagctgattccagcttttgaggtggtcgtatccagaaataaagtgaccgtagatttagggacacttactgatgaatacgaaaaagaaatcacaatccataccacagcgaccgacaagaaaacaggcgaaaaaatgattgttgccggaaaggacatcaagatcgtggacaaagtcacacttgatggcttggaagctggaacaaaatataaactttccggctggcagatgttaaaggaagaaaacgccgaacttctgattgacgggaaacgtgtagacagtaattatactttcactgctgacagtgaaaaaatgacggttgagattacttacagttttgacggttcagctcttggcggtcagaaccttgttacttttgaggaattgtacgatataagcaatccgaaagagcctgtcaaggttgccgaacataaagacatcaacgatgatggacagactgttcttatcacagaacgtatcatcaaaatccatacgaccgctacggacaagaacggcaagaaagaaatcgaagccggaaaagatgtaacgattgtggataaagtcacattagatgggctggaagttggaacaaaatacaaactttccggctggcagatgttaaaagaggaaaatgcagaacttctgattgatggaaagaaagtatccaatgattatgagtttacagccgacaatgaaaaaatgacagttgagattgcatttacttttgatggttcttctcttggtggcaagagccttgtcacatttgaggaattatacgatatgaccaatccagacgaaccaaagaaagtgacagaacataaggacatcacagacgatggacagactgtgacaatcaaggaagtgccggaagtcccagacacaccaaaggataccgacacgccggatacaccatctacggttactaagacaagtgacagcccaaaaacaggcgacaataccaatatctatgcttatcttgccatgctcggtctttcctgcgtagggcttggcggtatgctttacttcaaacgccgtaaaaagaaatcataaggcggtaatgtagcggttggtagagcgttcaaggtcgccaccctttttgcaacttcacgctcccgtgaagcacttggtttacgggagcgtgaagtccactaggggcgtggggagtgtagctccccacaaagtacagcaggaaagaaaataaaacagaaagaaaagaggtcaatcatttatggaattaagatttgtcgtaccaaacatggaaaagacattcgggaacttggagtttgccggagaaaatactacggaacagcagagaatcaacgggcgtatggctgtcattaacaggagctacaacctgtattccgatgtgcagagagctgatgatgttgtcgttgtgcttcctgccaaagctggtgaaaaacatttttcgccggaacagaaagtaaaacttatcaacccacgaatcactaccgatggttataaaatcggggaacgtggatttgtcaattatatcctgcttgcagacgatatgttaccagcagaaagtaaataagggggtattcagattatgagattagcaaatggaatcgtcattgataaagaaaagacttttggagtgttgaagttctccgcattacgccgtgaggttcatgtacagaatgaagatggaacggtcagtgaagaaattaaggaacgtacctacgatttgaagtgcaacacacagggacgcatgatacaggtatccgttccggcgactgttccgttaaaggactatgactacaacgccgaagtggaacttatcaaccctgttgcagatacggtagccaatgcgaattaccgtggtgcagatgtggactggtatgtaaaggcagacgatatttttttgaagaataaaggtactcatgccggaaattcacagaacaatgctccacagcaaccgcaaaaaaaataatgctatctattgaaacatttttagtatagcggtaaaatcctgtataaaagttaaaagaaagaggtaatttacttgattttatatttttccagcacagggaactcaaaatttgtagcagaaatattaaagatggatttgcaggacactgctgtatccctcaatcatatatttaaaaataatttaaaactggaattttatacagaaactccatatgttatcgtatgtccaatatatgcatggaggcttccacgaaaaattgaaacattcttaaagaaagctcattttaatggtagtcaaagcatctatattgttgctactatgggggattcttatgggttagcagaccaatattgtaaaaaaatctttctaaaacggaaaatggattataaaggttttgctggaattcttatgcctgataactatatggtttctaacaaaatgctttctaaaaatgaagctatttccaacatacagtctaatctgccatatttgcatgaaatttcaaagcatattctgaatagaagtgaattggaaatgaaattatcttctaaaaaaaatgcttggctgttatcaagtattgcgaattggggatttaatacatttatgcgtaacagtcgttcgtttaaagttgataatactacatgtatacaatgccaaaaatgtgtacgagtatgtccaacgaataatatttgtatgaaaaatggaagaatccattttaaaaatgaatgtatgttttgcttgggttgcatacataattgtccagttcacgctattgattataaaggaaagctcaaagcaaatggttattatctgtgtccacctttaacggatttattaaaataatttttacaatcaaagcagttagtctacatgattaactgcttctcttatgtccgaagaaaggagtttatatgaacatatggaaaaaatctaaaggtaacaggattcgtgccagcgacaaatcactgctctatcatttctgtattggctggctgttgctcctgttcgttgcggtgttcctgttactgaatctgcgacagcttcttgttacagactggaaagattttaacctgctccatgccggaattacttggactgcctacaattccattacggttctgatagcgactggtgtttgtgcattggtcgcttttctctactaccgttacggatatgaccgtatcaagcggttgctacacagacaaaaactggctcgtatggtgctggaaaataaatggtatgaagcggaaaataccaaagacagcggttttttcactgacctgcaaagcagatcaagagaaaaaatcgtgtggtttcccaaaatctactatcagatggacaacggcttgctccatatccgctgtgaaatcacaatgggaaaatatcaagaacagctcctgtccttagaggataaattggaatcggggctgtactgtgagctgaccgacaagacactgcatgacggctatatcgaatacaccctgctctatgatatgatagcgaaccgtatttcgattgatgaagtgattgccgaaaacggcggtctgcggttaatgaaaaatctggtgtgggaatacgattcacttccccatgcccttatctgcggtggtacaggtggtggaaagacctattttcttctgaccatcattgaagcattgcttagaaccaatgcggatttatacattcttgacccgaagaacgctgaccttgcagacttgggaacggtcatgggaaatgtctaccacacgaaagacgatatgattgactgcgtcaatgccttttatgagggtatggtcacacgctcggaagaaatgaaactgcacccgaactaccgcacaggggaaaactatgcctatctggggcttgctccacagttccttatctttgatgaatatgtggcgttcttggaaatgctcacgacaaaggaaagtactgcactgttaagtcagctaaagaaaatagtcatgcttggcagacaggctggatactttctgattgtggcttgccagcgtccagacgcaaagtatttcggggacggtatcagagataactttaacttccgtgtaggacttggtcgcatgagtgaactcggttacggtatgctctttggaagtgatgtgaaaaaacagtttttccagaagcgaatcaaagggcgtggatactgtgatgtgggaacaagcgttatatcggaattttatactccacttgtacccaaaggatatgatttcttaggtacgattggaaaacttgcacacataaggcaggacggacaggtggcgtgcggagcgaaagccacaggtacggactagccttgctggtgtggcggtagccacgccagcatatatcaagcccctcggtatctaacagaggggcacaaatcacaaggaaacatacacaaaagttaccgattcttggctaaaatcaagcgtttggtagctttttttattgctgtgacatcggactaaaaatgtcacagttttctgtaaagggggtatcgcactgaatgatacagagtggatacaggattttgcagacagacgtttgcagtacggtgtatcccagacgaaacttgcggtcatggctggaatcagccgtgaacatttaagccgtattgaatccggcaaggtggcggtcacagaagaaatgaaagtaaaacttttggaagctctggaaagattcaatccagaagcaccgcttaccatgctgtttgattatgtgaggatacggtttccgacactggatattggacacatcatcaatctgctttcatagtctccgatcccgtttcacggtatcttcgctccacattccggatcagcccatcaaatgcaacgtcatagatcccttccccgcgttgtcctttataatagaccttgacttcttttccattagtcccacgaagtaaaacatcctggatttctttcggatactgttcaaacggcgtatccaagtcaaaatgatattccttgcagagtgcttccagaatcgcgtgagtaaaactgctcttatcggtacaggactgccatcctgtcaccacgattgctccttcattgatgctgagtgatttgtccggaatcatcagatcttcatcaaactccattttatatccgagtccgaaacataccgggcaggcaccaaatggattgttaaatgaaaagcttctcggctcgatctcatcaatactgattccgcagtccgggcaggcaaaattctggctgaaattcagcggttcccctccgatcacatccacaaccagaagcccctccgcaagacttaatacactttctatggaatctgcaagtcttttttcaatccccggtctgacaaccagacggtctacaacaatctcaatattatgtttgatgttcttgtccaatgagatttcttcggaaagctcatacatatttccatcaatccttacgcggacataaccgcttttctttgctctgtccagaagcttgacatgggttccttttctcccccgcacaaccggtgccatcagctggatctttgtcccttccggaagtgccatgatctgatcggtcatctcatctgccgtctgcttcttgatctctcttccacacttcggacaatgcggaatcccgattcttgcatatagcagtcgaaaataatcgtaaatctccgtcacggttccgactgtggatctcggattgcggttcgtagacttctggtcgatagaaatcgccggtgaaagcccttcaatactttctacattcggcttctccatctgcccaaggaactgtcttgcgtaagaagacaaagattccatatatcgtctttgtccctctgcataaattgtatcaaatgcaagggatgatttgccggaaccactgagaccggtcagtactaccagtttgttcctcggaatatctacatcaagattcttcagattgtgctcgttcgcacctctgatctttatcagttctttcttttcttcagccatctgttcttcctcttctatctcttcgctttactccatctcattcaaatgctttttcagctcgatcagcttatcacgcagctctgctgccgcctcgaaattcagctctgctgccgctttcttcatctgcttttccagcttcttgatcagcttctccagctctgccacactcatggattccggatctttttccagcttcatctcttctgctgcaaccttctttgaaatactgatcagatcacgcaccgacttcttgatcgtctgtggcgtgattccatgttcttcattgtatttcatctgaatctcacgacggcgcatcgtctcatcaatcgccatccgcatcgaatccgtcatgttatccgcatacatgataacatgcccctctgcatttctcgccgcacggccaatggtctgaatcagtgaagtttccgaacgcagaaaaccttctttgtccgcatccagaatcgctaccagtgtgatctccggaatatccagaccttctcgaagcaggttaattccaaccagtacatcaaatacatccaaacgcatatcccggataatctctgtcctttccagagtatcaatatccgaatgtaaatatttcacacgaatgccaagctcccgcatataatcggtcagatcttccgccatacgctttgtcagcgttgtgatcagtaccttattcttcttcgctgtttctttatttacctcactgatcagatcatcaatctgtccttcgatcggacgcacttctacttccggatccagaagacctgtcggtcggattacctgctctgcccgcagcaattcatgagactcctcgtactctcccggtgtcgccgatacaaacagtacctggtcaatcttactttcaaattccccaaagctgagcggtctgttatcctttgccgacggcagacggaatccataatctaccagtgttgtctttctcgactgatcgccgtgatacatggctccaatctgtggaatcgtcttatgcgactcgtcgatcatgatcagaaaatcatccggaaaatagtcaatcaatgtacatggcggctcccctgctttctgcccggtcagatgcctcgaatagttttcaattccggaacaaaatcctgtctctcgcatcatttctatatcaaaattcgttctctcagaaatacgctgtgcttccagaagcttatcttcccctttaaaataacggatctgctgctccagttcttcttcaatctccccgatggcatgctccatattctccttggacactacataatgagatgccgggaaaattgccacatgcccgatcacattcaacacttcaccggtcaatgtatcaatctctgttattctgtctatctcatcaccgaaaaattcaactctgtatgcaattttttccgaatacgccgggaaaatctcaaccacatctcctcgcacccggaacgttccacgcttgaaatccatatcattgcggtcatactggatctcaaccaacttcttcagaacttcatccctgtctttggtcatgcccggtctaagtgaaatcaccatctccttgtaatcaatcggcgaacccagtccgtaaatgcaggacacacttgccacaatgataacatcattccgctccgaaagcgctgctgtcgcagagtggcggagcttgtcgatctcatcgttgatggcagagtccttggcaatgtatgtgtcggatgacggaacataagcttccggctggtagtagtcgtagtaggagacaaaatattccactgcgttatcggggaacatctccttgaactctccgtataactgagctgcaagtgttttattatgagcgatgacaagtgtcggcttctgtaattgctgaatcacatttgccatcgtaaaagtttttccagaacccgtaacccctagtaaagtctggcattgattgccttccttgaaccctttcacaagctctgcaatcgcctgtggctggtctccggtcggcttatatggggcttttaatttgaactcattcatggtaaatccctccatttgtgacttttactatgatcattatcagccaaaaattcgtatccagattcgtaacgaaaagcttattttatggtgaatagatgtccttttcacctcgttacgaataaaagtcacaaaactgatttttgcggataaaacagcactcggaaatacctgatgataccaggctccggttctgtcatatttttactgtttgttcttgtaacagtccctattatatcagacatttttttgaaagtatatagatgaaggtaagaaaaaagtacaaatgttcgattcttatttgtacttttctctcttactactattctattttttatcatgctgcgttgaaatattcctccaggattaagtctatttcaatcacttctgaataatcataatactgatctttccgctcttttggaataacttcttcaataaatggttccaatatatccagacagtcttctatgatttcctgcgtatctccataaacatctactgatatgatttccttggcatgtcccaataaatgcgaaacaccttttgaattaaagctattcttcagcaaaatagttgcataggtatttctcaactggtgaaaatgaatatcaggcaaatccaaggatttcaacaagtctttatagtatttctgatgaaagcctttactccttggattcccatatgtagaacaacaaatataattccagtcccggaactcttttggtctgcgtctgcggttcttctcataagttttccgttcttccagaattgcttcaaatacataatccggtattggaagttcacgcacaccagcaggtgtttttgttttaatttcctgctttgtcagcatcttaggtgcacagtcttctgctttactgtttggcttctttcccaactgacgctctactctcaacgtcctgtgaatgtaatcgacatcactgtatttcaaaccgttgatttcacttcttctgagccccatcaatacagcaaataaaatctgcatatgaatcggtgtttctttacttgcctcaatcaactgtagcacctgcggaagtgtcaatgttttcttttcgtcgattttcagaacacgatactctgtcttttttattttcttcggtaaattgattcccttcgcaggattagttgccaatacatttttgttaaatgcatactccaatgatgttttcatgatcgtcctgacatttttcgcaactgattcgtacttttctgcaactgtattatataattttctgatataaccctgattcagtgtagacatatacatttttccaagctgtggaacaatataattcctaatggcacttttgtaagttgtatatgtgtcgtctgttattcggggacgcataatatcttccagccagaagatcataaactcctctacccggattttcccatacacaatataggttccggtatgtagctgtccaatgacttcatcacgaaatgaatcagaaaggaattagcatgagcttttttggaggatacagcaaacgaggaagacagttggaagaacaggataaaaagttcctggaatttaaaaagcagatgagtgaccagaacattgtttttgaaaagggagattatctggctatggttttgggtgccttttgggcactctggccggctctggccattacactggcagtaattgtggggatcagcctgttctttttataaaaaaactgcaaaaatctgaaaggaagaatgaatggattataccaggaaggcatcaatacaaagaaaaactctttggcagcaaatcgctgatgtattaagagaagacatcattcgggggaagatcaaaccgggggaacgaattgtagaagaagatattgcggagaagtttcatgtaagccggggaccggtcagagaagccctgcgtcatatcggggaggaaggatttgttgtttatgagtctcataaaggcagtacagtaaagacgatttcctatgaagaaatgcaggaaaaatatcttgtccgctctaccctggaagttctggcaatcaggatcattgccggaaaacttccggaagaaatcgaacgggaaatggatgagtgtctggaccagatggaagaagctgcgaaagaaaaagatgtgtaccacattatgtgttatgatgaacagtttcattcatgcattgttcgagcagcaaagtgcgaaaccttatataaaatatgggcaatgctccgggaaagcaatttgtgcggatattatacaatgggtgttgaatccatcatcccctttgatgtacttcgctacaatcatgagatccttttaaaaggaataaaagaattgcctgttgaaaagacagcaaaattgattgaggagcattatatgatcgttccggaagttctgcatgaaaaacagtgtaagaaatccgaatagaacgaaggataatgtgatttcagttgttttagatcaggtggctaaaaagaccacctgacagcggcgttctacttcaaagcttcgtcacaaaacagtctgtgtaaatacttgcaattacaagaaaaaacgaatacaatatagaaaaagaggcaggtatcaggtggaaatgagacagatggaatttaaaatggagcgtccgggactggttgaacccggacagattgttgatgtgacagagggcgttgtagctgcgtatttttattatacgattgagccggctgtggcaatgagcgccaattatcgttcatggcagagacttaagtcaggacagggaaaagtgattgacgtaaagcagacaccgcaggggtattatgtggtgtgtgaatttgatgaagaggatgtggaataaagagaaggaaaaatccactggaaagaattcaatataaaaagatcagagaatgataaaaaatgtggttatcagactctgatctttttatattgtcatgtgtatggaaggaaactaccggtggcagactctgcagatgctgaatgatggaaaaaactgctatataatcctgaaccaggaacataaacagagaaaatctacagtccaagaagagcaggaagttccccgattgcgccaatctgtcttggtggatccggaatatcaccaaatccatacgaagcataaataaaaggaacgtctgctttctggcaggcatcaaaatcacctgaagtatctccgacataaaccacatcctgcagatgattgcgctccatcagaagaaggatggattcattttttggaacctgtgtctgaccaaagcataaaaaatctttgatatattttccgagtcccatcgtttttagaaaaacttcgatatatccacactggcagttactgacgatataaaggtcggttttctgagaaaggctttccagtgtctgcgcaacatccgggtaaagaacaccgtgatcggtttcaagcagccgattttcatagttaaagcaaagataaccgatccggtcacgttcttcttttgggcaggaaggaaagagtgtaagcgtgatctcatccattgtttttccaaaaagtgacttaagccaatctgctgtaagtgagagggaaaaatctgtattctcctctatcgcctgattccaggatctggcaactgcttcggttgagtcccagagtgtgccgtctacgtcaaatataataccatccatgattcaatctcctgtatctgaaaaattatttaacagattaaggatagcacaaggtggatatccgggcaatgatctgtaaaatattttatcgaaaagttacatgtgatgtcgaaaaaatgcgaattagtaagaaagaagaaaagaagtgtaagatagtagaaacagaaaaaacaaaagaaataagtgggggaaagaaatggctgaggggaaaatcaggatcaaagatattgcaaaaatagccggagtgagtgcaacaactgtatcgaatgtgatccatggaagaacggaaaaagtatcaagaaagacgagaaaaaggatagaggagatcctggatgaacaggaatatgccccaagcatgggagcacgtatcctttccggaaaatcttccgggatgattgctgtagttgttggaaaaaggcaggaatgggagcaggagagtgaaaaattagaagaaatactgcgtgagatcgagaagagtctggatgagagggaatactatatgctgctgcattttgtaaaaacagcagaagaatttgtgcgatatgcggcggtatggaaactggatggggttatctgtatctggctcaatgaagaggagtgtacaagaatccggcagatgtgtgcagttccagtggctgcgatatacagaacagaccggatttacggaaaagccggtgaggaagtcgcaaggtttctgtttaaaagagaggaacggagaatctggtttctggatggaacggaagagtacggaaaagtggtatggcagggaatgcagaaaatattttcaaaaaaaggctgctgtctcgaagaagaacaatatctggaaattccaaaagacagggatctgcggagaatgttctataaaatccggctggcagggcttgctttatccgcggatatgctcgtatttgcatctgccgtacagggagcagaggctgtcggttatctgcatgatctggaaatcaaggtgccggaggaaattgaagtgatggcagtcggaaaagaagaaacagcattcatttgccgaccgcagctgacaacagtcgaatttgacaaaaaacgatttgtccggcaggcaattgaagaattatatgtccagatgataaaaggatatattttgacaaaatccggaaaaatcagtgtgaaaacgataattagaggttcctgtaattgataaaatcgaattaaagtgataaaattttagaaagctacttgacaaaggtggtgtcaattgctacaataaaaaaacagaacgcactctgttttgtaaagtaaaggagtatgttatgagaaaacaagcttattcaattttggtttataacaatccgggactattaagccgtatggcaggattgttcagcagacgggggtacaatattgaaagtattaccgcaggtacaactgcagatccgagatttacaaggatcacgatcgtagcaagtggagatgaacagattctttcacagatcgagaagcaggttcgcaagatggaagatgtgatcgagattaagccgttaaatgacagcaattcagtatgcagagaactggttatgatcaaggttcgtgcaaatgcatctgaaagagcagaccttatttcactggcagatattttccgtgcgaagatcgttgatgttgagaaagactgtctgatgattgaactgacgggaaccgaatcaaagctgaaagcgtttatggagcttctggacggatatgagatcctagagctggcaagaaccggtattaccggactgaagcgcggaagcgatgatgtgatcatgtttgattaaagcagagagacgttttgaaaagagcgacgagctcgaaagcggcaccttcagggatgcagcagtagttacataagaaagctaggggcatggagcctttaactctatagaattcaataagtcataggaggaaattaaaaatggcagcaagaattttttatcaggaagactgtaatttatcagtattagaaggacagacaatcgctattatcggatatggtagccagggacatgcacatgcactgaacctgaaagattcaggatgcaatgtcattatcggtctctacgaaggaagcaaatcatgggcaaaagcagaagctcagggatttgaagtatatacagcagcagaagctgcaaagaaagctgatatcatcatgatccttatcaacgatgaacttcaggctgatatgtataagaaagacatcgaaccaaaccttgaggaaggtaacatgctgatgttcgcacacggattcaacatccactttggatgcatcacacctccagcatacgtagatgtaacaatgatcgctccaaaagcaccgggacatacagtaagaagcgaatatcaggcaggaaaaggaacaccatgtctgatcgcagtagaacaggattacacaggaaaagcctgggacagagcacttgcttacggtcttgcaatcggtgttaattttaccacaaaaataggacctttcgcatgaacgaatggtcctatttcttttagggacttatttcacagccccatttttttctcctccgtggtggcatagactacatttatttttcgcccatctctggtggaatcttttctaacaactgtcggatattatcacggatcaatcgtttataattatcaggaagcggtgtgatcatatccaggatctcggcattgatcggatcctttgaatgaattgaatcatccaggtagtcacagatcagataatcaaatttgacatctaatgcttctgaaaaattaagcatggttgcaaaggatgttgcctggctgccattttcaatccggcttatcgttgtctcatcaagatttagtttttctgctagtgctgcctgtgtaagaccggctttgtgacgtgcctgccgaacgcgtgtaccgaaattcttttccatgctatatctctccttcataaaagtagtgtagcatttcaatttgaaaaaagaatgatattatatgcaagttaactttacaaaaacgccgtgataggatatgattaaaaaaaggggggagagaaatggattgggaatcgtacagaacagatattgaggcgataaagcttgcggtgaatgaatgtgaaagacttggagtggataaagaagaactcctcataatcagtatttaccgtttgtatgaattttataaaacagaagacgacagagtctatcttctgggggcattattgcatcttaaggcttatcttgagctggggatggaatatgaaaagaaccgtaagattttttcgctgattttagataattacggggtatgttatcaggatatttttcagggagctgaaaaaatggagtgaaaaaatctgaaaaattccaaaaaccaggttgacaaacagagaataaagaggtaatatattaaccataaattgtaaaaccgttgagaaagaggagtaggttatcgaacgatatcacagagagcagcaggtggtgggattgctgtatggagttgataattgaatggactttcgagggcagcctgaaatcagataattgagagtatggtttgtcgggaaccaaacccgttatcaataagggatgtatgttagtacataaaagaggacaggaaactgttaaagttgagtggtaccgcgttagtagaagatattagtcgcctcaatccgtagaaggattgaggcgttttttatttcataggaaattccgaaggaacttcctatgaaataaaaagtctccggcaggatgttacatatgtattcttgttgtggtacggcgcggaatcaagaaacaccttctcttgaaagctaacaaagaaaattatttatcaagaagaggagaacaaaattatgaaaaagagaacaatggcagtattattaacaatggcaatggcagtaacaatgatggcaggatgtggaagcaagtcagattccaagacagcagatggagaaaagagctatacaatcggtatttcccagtttgcagagcacggatctttagataactgccgtgaaggatttttagagggactgaaagaagaaggtatcgaggaaggaaagaatctgaatgttgaatacaagaactcggcagcagatatgggaactgcatcacagatcgcaagcagctttgtatccgataaagtagatctgatctgcggaatcgcaacaccaagtgcacagacagcatacaatgctgcgatggatacggatatttcggttatctatactgcagttacagacccgaaagcagcagagcttgcagatgataaagggaacccggttggagaagtcacaggaaccagtgataaacttccgattgaagcacagctgaaaatgatccgtgaacttcttccggatgcaaaaaagattggtgtcctctatacaacaagtgaggcaaacagcgtatctgcaattgctgaatacaaagaaaaagtcggtgactatggatttgaacttgtagaaaagggaattacaaatacatcagaaatcgcacttgcaacagacgatcttctgtcacaggtagactgcatcagcaacctgacagataacacggtagtaagctcacttgcaaccattctggataaggcaaatgcagcaaatatcccggtattcggaagtgagatcgaacaggtgaagcttggatgcctggcagcagaaggccttgattatgtagcacttggcaaacagacaggtaagatggcagcaaaggttctcaaaggagaaaagaaagcatctgaaatgccatttgagacgatcacagaagcaggactttacctgaatacaaaagtagcagaaaatcttggaatcacagtggaagacgatctgaaaaacagcgcagtagagacatacgattctatcagcgaaaactaaatttgaattagaaaagtgaggagcaatgcaatgagctttgcagtatcgattttggagcagggactgatttacggaatccttgcattgggaatttatataacatacaaaattctggattttccagatctgaccgtagatggcagctttccattaggagctgccgtaacggcgcttatgatcacaaaaggagcgaacccgtatctgacacttccggctgcatttgcagcaggtgtggcagccggtatctgtaccggactgatccatgtcaaatgcaaggtaagagatctgctttcaggtatcattatgatgacagcgctctggacgatcaaccttcgtgtggcaggaacagccaatgtaccattgttttcccagaagacaatctttaaaaatgatacactggataagctgcttccgtcaggattttccgcttactctacattgctcatcattctgatcattgcgttaattgtgaaaatcattctcgacctttacctgaataccaagtccggatacctgctccgcgcagtcggagataacgataaactggtaactgcaatggcaaaggatgaaggaaatgtgaaaatcctgggacttgcgatcgcaaacgggctgtgttcgcttgcgggatgtattttctgccaggaagaacgtgtatttgaaatttccagtggtacaggggcgatggtaatcggtcttgcaagtgttatcatcggaaccagtattttcaaaaaaatcagttttgtaaaaacaacgacagctgtattgatcggttctatcatttacaaggcctgtgtggcaatcgcactgaagaacttcgaaccgcaggatatgaagctgatcacagccgtactattcctggtaattctggtgcttagtatggagagaaagaagaaggtgaagaagaatgctggagcttagaaatattcacaaatattataatccgggtacagtcaatgagatgtgtctttttgaggacttcaatctgacgatcaatcagggcgaatttgtatccgtagtaggaagtaacggttccggtaaaacttcgatgttgaatatcatctgcggaagtattccggtagaatccggacagatcctgatcgatggaaaagatatcacaaaggtaaaagaatacaagagaaaccagaagatcggacgcgtgtaccagaatccatctatgggaacctgtccgtccatgacgatcttggaaaatatgtctcttgcggacaataaaggaaggttctacggacttggacggggaactaataaggcacgtattgattattacagagaacagctcgcccagcttggtcttggactggaagataagcttcatgtcaaagtcggatcactttccggaggacagcgccaggcgatggcactgctgatgtctacgatgacaccaatcgagtttttgatcctggatgagcatactgctgcgctggatccaaagacagcagaactgatcatggagctgaccgataagattgtaaaagaaaaaaatctgacaacggttatggtcacacacaatctccgctatgcagtagaatacggtaatcgtctgatcatgatgcatcagggacattgtgtgatggataaggcaggaaaagataaagaggatacctcgatcgatgaaatcctgacgatgttcaatgagatcagtattgagtgtggaaactaaaaaatacaagattatgggttataggacaaaacgtgttgatggctaatcccagccatcaaacgttctatccacattatgtaagtcgctccaaagcttttaccagaattcctgccggtcttgcgtggattccctgtgcatctgttactacatacttaaattctttcatgattcaacactcctgttctttaaaaaatatttagaaaattaataagttactactctgctttcaatggctttttgagtaatacaattcccgccattgctacgacagctcctacaaccaatgctatcaaaaacatcaatggattgtcaataattccgatgacaaaaattcctccatgcggagctcttgatccgcatccaaacatcatggataatgcgcctgctattgcagaaccaactatacatggcggaatgattcgaagcggatcagatgctgcaaatggaatggctccttctgtgataaaagaaagtcccatgatgtagtttgtgatacttgtctgctgttcactctttgtgaaacggtttttaaaaaatgtggtggcaagtgcgattgcgatcggtggaaccatacctccgatcataacagatgccataatatcaaactgaccacttgcgatggatgccgttccaaatacatatgccgctttgttgaacggtccgccaaaatcaatggacatcatacctgcaagaaccgctcccagaagcatcttgctggattctcccattccggaaaggacattattcagccaggtgttaaatgctccaaccggtgggtttacgataaagatcataaatgctgccatgatcagaatcccaaagaatggatacagaagaaccggttttgtcccttccagagttttcggaagcttgtcaaacaatttcttcaatccgatcatcaggtatcctgctgcaaatccggcgatcagtgcaccgaagaatccggatgaaatccatgcgtcttctgcaaggaatacagaagttccggcttttgcaagaagtccgcctacaataccaggcatcaatgccggtctgtcaccaattgccattgcaatataaccggcaaggatcgggaacatcatcccaaacgctgtatttccaacggtgttgaagaattttgcaagtggagttccactaccaaatgctgctgtacctgcatttgcaccgtcaaccagaaaagaaagcgcgatcaggattccaccgccgattacgaacggaagcatatgggatactccattcatcaggctcttataaatcttgcgtccgatggtatctccgtcagctgacgcaccaccctcttctgttgctccacccttgctgtgataaactggagcgtttccactcaaggcacgttcgatcagctcctgtgctttgttgattccgtcagatacctttgtactgatcagcggcttgccgtcaaatcttgccattgcgacatccttgtcggctgcaatgatgatacagtcacaggcagcgatttctttcggtgtcagtacgttcttggcaccaccagatccgtttgtttctaccttgatggtaactcccatttctttcgctttcttttccagaccttccgccgccatgtaagtatgggcgataccggttgggcatgcggtaactgcgaggatctgatacggttttgcagatgtatccgccggagcttctgctttttcttctgcttcttccgggaatttttctttctcggctgcatcaacataagcaagaaattcatcaacatcctttgcatgaagcagcttgtttctgaaatcctcatccatcagaagcatggacagacgactgagtacttccagatgtacattgtcctctgtatttggtgctgcgatcaggaaaataaggtatgccggttctccgtccagagaatcgtaatctacaccctccggaagtaccatggctgcaagtcccggtgcgcttaccgcttcagtcttgccatgcgggattgcaatgccttcaccaattcctgtagttccttcttcttctcgtttgaagacggtttcacgataggtgtcaatgtcattgatgttcccgccttctgccataagatcgaccatttcacggatgacctgctctttggagtctgccttgccatcgaggcaaatactttgctttttaagtaagtctgtaatcttcatcttgtcattcctcccatttgattttatatatggtacacttctgccggttctccaagaagcgcaacaatctcatctcttgtagcgagccacgaacagaatgccgaagcgcttcctgccgccacacccaggcggaatgctttttccatatcttttgtattcagatatccggtaataaatcctgccaccatagaatcacctgcgccaacagaattgacaacctttcctttcggaggcatggtctcatagacttttccctcctttgtcacaaggatcgctccgtcacctgccatggataccagtacatgctgtgctccaagtgcctgtaacttcttcgcataaatgatgatgtcttcttttctcttcagttctacgttaaacatctcacctaactcatggttgttcggtttgatcaggaacggatgatatttcataacttttaaaagaagatccttggttgcatccactacaaaacggatttcttttccggaaagtctctccaggattctctcataaatatcttccggcagagtattcggaatacttcctgcaaggatcagtacatcgccttcttccagcttatccagcttttcatataatgcctgaattgcttcttctgtgataaccggtccctgtccgttgatctcagtctcagttcctgcattgatctttacattgattcggctattaccttcttttaacgggataaaatctgtctcacatccgaactcttccagcatcttttccagtacatctccggtaaatcccgccttgaatccaagcgctttgctcttaagtcccagattggaaaggatcacagatacgttgttcccttttcctcccggatagatatgttcgcttgttgtccggttgatctctcccgggatcagctgatctgcctgtaccacatagtccaaagacgggttaaatgtcactgtgtaaatcattattttgcaacctccacaatatttttatatttgttaaatgtagcatccttaagctttgttgtaatgatgtccactgcatccagttctgaaaatgttaccggtgctacctgaccgaatttggttgaatctgcaaggatgtaagcctttgcgcttcttaagatcgccatctctttgatcgcagcctcccggatatccggtgtggtgcatccactctctatatgaatcccattggttccgaagaatccttttgtgaaatggtatcttcccaggtttttcattgcttcctctccgaccagtgccagcgttgcttcttttaattccccaccgatcagataaactatacatcctttctgtgtcagcttcttcgcatgcatgattccgtttgtcacatacacagcgtcctgctctgtcaggaaatcaatcaggaaatccgtggtcgttccggcatcgatataaacaaaatcatctttttcaatcagagatgatgcatactttccgatctgcaccttttcatcaatgttcagatcctgtctgactgcaacagattcgtctctggtgtactgcgccatattgactgcggttgcaccaccatgtaccttgatcagctttccttttttatgaagtgttgtcagatctcttcgtatcgttgactctgacatatccagaagctcggtcagttcctgaacagtgattgtcttgtgttcattcactaatttcagaatttcactgaatctttcttctgcaagcacttatctcacctccatttcgactggttatgactgatttattcaattgtatttcatattccagtcattttcaatcatttgttttctttttcgttcatatttagatctaatatatcgcctttttcagtcaaagtcaatcattttcagccataaataactaccaaaaaaatagggatgattttgtgcatttttatgggtgtggaaccggtggtgccagagttccgacttgtgtttcatctccattgcactcaacggaattggcagaaagtaacaactttttagtttgtatgcgacaaacgtttgaacactttttgaacaccgcaaccgtgatgaagtcctcaaagcccctttctatcagtatttgtgattgcttaaaacggttcgattccggtctgcggcattaagtaaaaagtaggagaaacgttgaatttacagcgtttctttttttcgcaacaaaacgggagagcaaaatccccatgcctcccatctttcagctcatccattcttattcttcaacagcccatttctcaatctgtttcataaatttctcatcttctgaaataacttttaccggcttcttataatcaattgccataagtcccagtagtccaaatcgggttaatctttctttgtttattgcaaaattcataactcttcgttgacacatgtaagcgattcgactacctgtgtatgccgtaatccaagctgtatccttatcaactccgagtttcatcaaattctttatacgattctgtggggttttcccttgctgttcagctatatacttccttgttatctaggtgtattcgggactttcacccgttagagcgcgcccatggtgcgcaaactacaaaaaggatgtgccaaggcacatccttagataacttattctatattctgcttaccgaatcagctgttccagctcactcttttcctgaactcctaaagttctctctgcgacctttccatctttgaatacgagaaatgtcggaattgacattaccttatattctctggcaagcgccatctgctcatccacattcaccttacctacctttacatctgtaagctcctgtgcgagttcatcaacaaccggtcccattgtctggcatggtccacaccatgttgcccagaaatctaccagtactggtttttttgcatttaatacttcttcttcaaaattctctgttgttaaattgattactgacatgatagacatcctcctgtttcattatctttttcttctttaagggcagtaagccgttcctctactttctggatcgtgattctttccagataatcattacagctcctgttcatccctgttacaagttcgtccataactacagacatcccacttgcaaccaaacactttttatccgggtttcctgaacgccaggatgcttttacaagcgtattctccagcgcatcactgatctgcctcagcgtaatatccgaatttgcttttgcgatccggtaaccgcctcccatgccttctcttgtctcgatcagaccggctttttttagttttcccatcactctgcgtatgcatacaggatttgtacatacattatctgcgagttcttcacttgcgatagtagcattgctgcgatccagaaatacaagtgcatgaaccgctattgcaaattcacttgtcacgcttctcccctcatttcttatatattgaactgtattttttttaattacagtttatactgtaacaatatcacatacagtttgccatgtcaacctctttgtctggattttgttatgattttttatctctgttgacatttgcgaggaaatatgatagttttttgtgaaaattttgtttatttatgaggattatctgctatgaataaattattacataacaatacactttttacactcacactacttggcatcgcgaccgcacttgcctttctttttttctcattcgtttctgaaaatactgcaaacatcgcattactttatattattgcccaaatcttgattgcacgatatacgaacggatacctgcacgggctcttttcttctgttttctccgtaatctgtatcaatttcttctttacctatccgtttttccgactgaatttcacattgagcggctatccggtcacatttatcggaatgttgatcattacattgctcaccacagcaaccacttcctctcttctgtctgatggttccatcttatcagatgcagaaaaagagaacttcttgaaaatattgaaaatgactccagctggcgcctcaatatggttgaaaatcttctcagtgtaacaagactccggagcttaccgtcactgatcatccagaccacgtaaccttctgtgtcaaagatttcggacatggtctgaacccggacgttattccggatattttcagtggcatctgccacaatactggttccgttgactcccacaagggtatgggaatcggcttatcaatctgcaaaacgatcattgacgcacacaatggttatatcgaagccaaaaaccacaccaatggtgctttatttctgtttacattaccaaaagaagaggaggaaaacattccatgcagccaaaagtaaatatccttacttttgttagaaagctgttatatgggcacaattataaagtaacaaccgccataaccggtactgaaggtcttcagctgataaattctatctgtccagatctcattctccttgatcttgggctcccggatatggatggtcagacaatcatccggcaggttcgtgaatgatccgactgtccaatcatcgtcatctctgcccgtacaaatgaacatgaaaaggtaaaagctctcgatcttggcgcggatgattatatcaccaagccattcggttccgccgaactccttgcacgtatccgcacctcactcagacacagtacccggatgaatacctcttcagatcagctcttccacccttacaaatgtggtgagctaatactcgattttgaaaaacgtaccctgactatcagtggaaatatcgttcatttgactcctatcgagtataagatcctggtatttctcgcacaaaactgtggaaaagttatgacatactcttctatcatcaataatgtctggggaccatacgcagatgataataatcggatcctccgcgtaaacatgaccaatatacgccgtaaaatagaaaagaatccggcagatcctcaatacatctttaccgaagtcggcgttggctaccgtatgagcgaagaacactgttaaggttctgctaagaaagcttccaatctcttttcaaattacatattttcttataaaatgactttatcaaaagaaatacaaagaactggagtgagagaggcatgaatattggaatgttacttttggttataattggaggctttgcaggtcttttttctacactttatatttgtatcagtcttccattcaccattatatggaagatttatcgccgggttgcaaaaggcatcccgattatgaaatagctgtttcgtttaacatcctaattccaaataagaatgccgaatatttctcctgctgataaggtttctttatatagtattacaccaatcaaggtagctgcaactggctcaactgatgccaaaatagaagcttttccattatctaaatttttaagaccggcagtatacaggcaaaatgcaagcactatacttaaaaaaccaaatttcaaacttgcggacaaaaattcccatgcttccccaaagtatccctgccagaattaccattcctgatgcaagttttttcattatcctgcctccttatatccaaaaaggatgataacgcaacaagcattgttacgcaatcatccttgaaatactgtttttactataatacaaatatgcagagctgtccagcctaaatcagactgaatcttttattatatttaaatttgaccgactccacatatggtgtccggataaatatcatcgatacagttccttcggaatttcctatgaaataaaaaaaactgtaagcaattgcttacagttttcaactccccgagttgggttcgaaccaacgacccttcggttaacagccgaatgctctaccgctgagctatcgaggaatattaaagatactttcatgtaccttcaaaaccacatacaaatttaaatctctactccatccattctttcttaccctgtcctaccttcttggttatgccctcgaccgattagtaacagtcagctccatgcattactgcacttccaccggaaagtctgcccttttttagtcagaaaacaaaatatttttttctcatttaattattgacatttattagctggactcatataatttcaaaaaacgtcacgtcactatattatcaatctaccatactaaagtcaaccaaaacttgctatttactttcttttttgataaagatacaataagaaatacagaaattactgtagaaagagtaaaacagaggaatataaatatatggaaacaaatgagattattgttcaccatgcgacggagaataacctgaaaaatgtatccatccggataccaaagcatcagatcacagtatttaccggagtatcaggttccgggaaatcttcgctggttctggatactcttgcggcgcagtcacgcagggaattaaatgatactttcccgagttttgtgcagcaatatcttccaaaatacggaagaccgcatgtagaacggattgagaatctaccggcagcaattgtaatcaatcagaaaaagccgtcgccgaatcagcggtcgacggttggaacttatacggatacctatacccttctgaggcttttattttccagagtgggacagccttttgtcggttattcggacagcttttcattcaatcatccacagggatgctgcctgcggtgtaacggacttggagaagtgacagatctggatgtgcataagctggtggattttgataaatgtctgaatgatgacggggtgatccattatgtggcatttgagccggggcagtggagatggatccgctatgcaaacagtggattgtttgatctgaataagaagattaaagactattccgaagaagaattggaactgtttttgtattcaccgcagatacgtcttaagaatccaccggaaggatggccgaaaactgcgaaatacgaaggtcttgtgcatcggatgtatcgcagtgtcctaaattcggaagaaggaaaacttcacagggagttattggatccgatcaccagtcatggagtttgtccggagtgtaatggggcaagattgaatcagaaggtgttgtcctgcaaaattgacgggaaaaatattgctgatgtaataaaacttccattatccgagctgcgtgcgtggattgatcaaatagaagatccgcttgcaaaagatattcaggatacactgcataccaaactgtctgcacttatagatatcggactgggatatctgtctctggacagagggttatctactttatctggtggagagatccagagatgcaagattgcaaaatgcctgaattcctcgctttctgatttgttgtatattctggatgaaccgagtgcagggcttcataatcatgatattgagcggatgcgccgtgcactggaaaaattgagagatggtggaaatacggttgttctggtggagcatcaccggaaaatgatcgagatggccgatcacattgtggaaatgggtccggaaccgggaatggccggtggaagagttttatttgaaggcagttataaggaacttttaaagagtgatacgccgaccggagaagagatgcggcttactacttctctaaaagcaaaggcaagggaagcgaaaggaatatggcggatggagcatatccatcttcacaatctgaaggacattaccatcgaatttccaataggaaatctggttgtgatcgctggtgttgccggatccggaaaaagttctctgatggaaagcttttaccgcagtatgggagaggatgtggtgtttgtaagccagcgcgctgcaggtgcaagtctcagatccactccggcgacctatctgggagtcgcagatgaaatccggaaaatatttgcaaagcggtgcggtcagaaggcatctttgttttcttttaacggcgcaggaaagtgtccggcatgtaagggaaaaggagtgatcgtatcggatatggcatttatggatgacatcgagacgacctgtgatgtgtgtaaaggacttcggtattcaaaagaagttctgcaatacgaagtagatggaaagaatattgcggaagtgatggatttgactgttgcacaggcaggggaattcttcagggggacaaagatcagcgaagcgctggagcctctggaaaaagtaggactttcttatctgcacctgaatcaggcactttctactttatccggcggagagttgcagcgaatgaagtttgcttcctatctcggaagtaaagaccgtattttcattcttgatgagccgacaaacggattgcatatcaagaatgtccggagtctgttaaagcttctgaaccagatggtggatgaagggaattccatttttgttatcgaacataacatagaatttatcaaatccgctgattatgtggtagaattaggaccagaaggaggagatgccggaggaagactgctgtttgccggtacaccgtctgagatgaaaatgagtgagaaatctgtcacggcagaatatttatgatgataccagattgctccatttccattgctacgcaatcctcctatttataattatgaaagatttacagaaacagaaatatttaccaaaaagatagaagaaaaggagacgaacgttatgaaactaatgattgcatcagatattcacggatccgcatattattgtctggaaatgctggatgcgatgaaaaaagaatgtccggacagactgttacttctgggcgacatcctgtatcatggaccaagaaatgatcttccgctggaatacgaaccaaaaaaggtaatcaaaatgttaaatgaagtcaaagagaaattattctgtgtacgcggaaactgtgacacagaggtagaccagatggtactggattttccgatcatggcagattatgcagtgatcccgtgcggcaacaggatcatttacgccacccatggacaccatcataacgtcatgaccccaatcccaatgcagccaggcgatattctcctacacggtcacacccacgtaccggcctgggaaccattcggaaacgagaacctctacttaaatccaggctccgtttccatcccaaaagaaaacagcgcccacagctacatgatcctggaagacggtctcgccaaatggaaaaacctatacggcgaagtttaccacgaacttatgctgtagaaaaatctacaatattaagaaaaagtagaaccgaaaaactatcacaaatggaaacatacaacacctgaaaaagtgaaaaacttttattttggcgaaaatattaaacaaaataaaaccccataaattgtcgacattcgccaatgtacatccgacaatttatgtaataaaatgaaactaagaaaagcaaaggagaacctaacaatatgagagcttacgaaagatttttaaactacgttccggtatggacaaccagtgatgagacaagcgatactgtcccgtcagcagacagagagctggtactggcaagaatgcttgtagaagagatgaaaggtcttggaattgcagatgcaagagtggacgacaagggatatgtatatggacacatccctgcaactcctggatgcgaagacaagccgtcgcttggtctggttgcgcatatggacactgtggcagatgcatcaggggaaaatataaagccacagatcattgagaattatgacgggaaggacgttgtcctgaaaggttccggagatattctgaaagtagatgagttcccgtaccttgcagaattaaagggaagaactctgatcacaactgacggaaccacacttcttggggcagatgacaaggcgggaatcgcagagattcttaccgtggcagaagagatcatcaaagaaggacttccgcatggaaagatctgcatcggatttacaccggatgaagagattgcaagaggagcaaagcattttgatgtggaaggttttggtgctgactatgcttacactttggacggtgatgaggaaggcgagattcagttcgaatgcggtgaaagtcgcacgtccggtgtgaagtgggggaaaatccggcgataacctcaaaggattacctatcactataagcagagagattgctgtacaccgcactgattgcttttatctggtatgaaggggatgaagaggaaaagaatttgaatactcttctggatcttttgaatgaaagcgaaacccgtgaagaggatgaaacttaccagaatccagtggatatgatgttccaggaactggaagaaagagatccgcagcactttgcggtcagacagtataaaaaatacaaaatggcggctggaaagacagcgaaaagtattttgatatcgtgtggggccagacttgccccatttgacatcgcagagcttcgagaaatcatgtcttatgatgaaatggaattggataagatcggggataggaaaacagccttgtttctgattatgtccgatacagatacaaccttcaactttgtgattgcgatgctgcagtcacagcttttcaatctgctttgtgataaggcagacgatgtatatggtggaagacttccggtgcatgtgcgtgtcatcgctgatgagtttgccaacatcgggcaaattcctcagtttgacaagctgattgcaactatccgaagcagggaaatctctgcttctattattttgcagtcacagagtcagctaaaggcaatgtacaaggatagtgcagataccattctgggtaactgtgatactacactatttcttggtggaaaagagaaaactaccttaaaggaaatgagtgaacttctgggtaaggaaaccattgatctgtataacacttcggaaacgaggagcaatcagaagtcctttggattgaattaccagaaaacaggcaaacagctgatgacagaagatgagattgcagtcatggatggaggaaaatgtatcctgcagattcgtggtgccagaccatttttctcagacaaatatgatatcacgaaacacaaaaattatcggtttcttgcagatgaaaatgagaaaaaccgatacaaagtagaaaaagagttaaatccgcagtacacaccgaaacccgaagaagaggtggaggtaattcaggtggagctgtcggagtaaccttgggaatgaacgaaaaataatgaggaaaggaataactgacattaggtgcgccggctttttagtcggtgttttttcattcccgtaaacacctgaaagaagtcagttttggtgaatgtatatggcattttttagcagtgcaattacaactttaaaaactcttgtagtcgcaatcggcgcaggtcttggcgtgtggggtgtcgtaaaccttctggaaggatatggaaatgacaatcccggcgctaatgcttatgtgtcataaagtagcatataaaaattgatatgcagccctactattccaaacaaacattgttaaaaatgacgaaatcttttgaggttttacatatcatatcgtgaataacgcttgatttatcggcattttcatggtagcattatcctaagatatagtgtagaaatgtatacaaggatacttagttgaaaggagggaaatttggtggactatttatgggtgttggtattattgattttgggagtttgtatggtctgttatcctaaaatattatggaaaatagaaaatttattcacagtaaaaaatggtgaaccaaccgaactatatttagtattaatgcggattggtggtgtattttttattatttgttcagttggtatgattatatatctaattataaaatgaaacacccttatagttcttaaattgtatcctattattcgaattccagacagacagtacggagtataaagcaaaatcgttgattttaagccatttttaggcaatataagtaactataaaaccatataaaaatattaaaaaatgcaattttaatgcaatgaggtgcaatcaaaatcatctgatttgtacccaatcccaaatctcaatatcaactatttagttaaagacgttcaataaatgagcgtctttttttcatacccaaaatcgaaaggagaaagagaaaatatgaataagctagtaaagcgattgctgacaggaacacttgcttttgcaaccattctcacagcattaccagtgacggcggttcatgcttccggcaatcaatactggacagaatcagcagaacgtgtcggctacattgaacacgttatgaatgatggttctatcaaatccacattcaatgagggacacatgaaagttgagggcgaaactgcctactgcgtggacatcaacaccaatttcaagaatggatataaaacacgctctgacgcaagtacccgtatgagtagcgatcaaattgctgacgttgctctttccttagagtacgtcaagcaatataccgcttctcatacgaacttgaattataaacagggatacttgctggaacaatgtgttgtctggcagagattgagtgaacagctcggctggcagtgcgacaacgtcagagcttcctataatgaaatctcacaggcggtacagaatgaagtgtacgctggtgcgaaagcatttgtaaaagcaaataagggacgctatgaatgtggcggttacatctacactggcgaaggacaggacatcggacagttctgggcgaagttaaatgtaggaaatgcaaaagtcaaaaagacttcttccaatcccacggtcacagatggtaacgccagctatttctttgagggtgcgacatttggtgtctattctgataagggctgtaacagccagcttgccacacttactgccgatggaaacggcgataccaaagaagttgaggtaaaagccggaacagtttacatcaaagaactttccgcaccaaaaggttacaaactggattctactatccatgccttaaatgtggaagttggaaaaacagcgacattaactgttgctgacgctccaaaggtcacagaaactttgattgatttattcaaaatcgacatggaaacaggaaaatccactccacaaggaaatgcttctttagagggtgcagagttcacatggagctattatgacggatactacagtgcagacaatcttcctgtaaaggctacccgtacatggacaaccaaaaccgttgccgaaaaagacagtgacggaactatccattatgtatccagacttgccgacagctacaaagtatccggcgacagcttctatacacaggacggtaaaaatgtactgccacttggtacactcactgtcacagaaacaaaagcaccaaacggctacttattagatggtgcatatatgcaggctgacggaagttccgaacagattaagggaacataccttacacagatttccgaagatagcgaacttgccgtactctctggaagcaaccagtattccgtatccgacaaggttatccgtggcggtgtgaaaattcagaaacgtgactttgaaacaaaggataccaaagcacagggaagtgcaaccttacagtacacagagttcaatatcgtttccttaaataacagtcctgtactggttgaggggaaattatataacaagaatgaaactgtcaagaagattcagacaggaattgacggaatcgcttctacttctgctgatttacttccttacggaaattacagattagaggaaaataaagcaccagagggctacttggcagacggtgcaaaggcaatcgacttttctatcacggaagatggaaaaatcgtggatttgaccgacaaatcccactctgtctacaaccagattaaatcgtaacttcaaactttatggaaactaactgccacgtcctacttttgaattaatgtgttttgctcatctctataaaccagtataacgggcaattttaaagaatttcttaaatcgtaatgagaaaagttaaaaaaataataaagctaaggaacgtttaatccttagctttatgtaggcggtagccaatgccccaaacagtatcaataaattctgtatcagagcatatcgcttttaatttattgcgtaaattactgatatgaacattaagtgtattatcttcagcaatatattctgtatcccaaacactttgaaaaagattcgattttgaaaatactttatctggatatttcatcaacaattctaaaatgccaaattctttagcggttaaggataattctattccattcaaaaatgctgtatttttctctaggtctaaagtcagattgttatattgcaaacattctgtctggctattttgaaattgtactcttcgcagattactttcaattctggcaagcacttcttccatatcaaaaggttttgtgatataatcgtctgctcccagacgaagcaagtcgattttattttgtgtagtttctttcgctgaaataataataacaggtatcgtaaatttcttgcgtacatcagataaaataatatcaccactccgataaggaagcataatatcaagtataatcaaatcaattttttctttattcaaaaaatccagaacatgaagtccatcatattggcaatgcacagcatatcctttttcttttagaaaatcagccaataacgcatttatttctaaatcatcttcaataatcaatattttattcattagcctacctcattcctgcaatgctactttcccattatacatttaaggttgtatttcctcaataccattgcaaccaattatatgagagggattcttattttgtcaatctaattgtaagcagaatagtatagattggataaacaattaccatactattctgctgtaatatttattctacaatcttccagttatcgtccttatgtaacacaagctcatactgtgagatttgcgtcattttcgacttgttatccagatactttacagacacactgaccttgagattatcgccgtctttggtaaagacagggtttaccagttctgaaaatacatagtcgccggatacaggagcaagcacaccgtctttgacatagtaggcaagttccttttccgtagctgtcgggtacagcttaaagaatgtttccaagaaagcggtagcgtctttgactgaatcggagctgacactgacatcggcttcctgtgctttcggttcatactttgatttctgcattgccggagcaagggtaggattctgggtaatgaccattgcaccgtccttatccacatgaacggttacagtgtaattttctgtgactgcctgtgtctgttctccctcttttacctgctgatctacttcgtaggcaacggtaaaatcgtccgttccagactgttctacattccagaccagcacatttgtaacagtagcactggttggtatgtccgttctgatggtatcggcgttcaagtcctgcaattctttggtaaggtatttactgatttctgttgtccttgcttcaatggcttccttgctggtatcccatgagtagtaggcttttgcaaagttcttgacggaattctcaataccgttagtatcgttcaatcttagctgaatgatttctttttcatgtaccgtgtgggtgtcaatggcggtaaagttcttatacacaccaaagctggtgcttgtcagaagcaccgcccacaacagcaggacagattttttatgtgtcccgactttcatggtacgcactttcttattcttaggtgctttctctattttttctttcttcttaaacatatttcaagtcctttctattgtttgattcttccggcacaaatgatgtgctgttgccagtaggcagaggtcaaatcggtataaccaatgggatttccggcatggtacatctgattatttccagcataaatacccacatgggtaacatagtcactggtattgtaagtggaatggaaaaataccaaatcgccagcctgtgcctgtgacaatgggatatgctgtgttgcgtcatactgtgcctgtgcggttcgtggcaaactaattccggcttttccgtagcaccactgggtaagaccagaacagtcaaaagaggtgttcggattactgccaccatagacatatttccagccttgatatttcaatgcttcattcataaccgcctgtacggttgcgttgctgaactgctttacagtcagatattggttgaccagctccacataaaacatatttccgtagttataacgccagccaccatttttactgacagctatcggatttgtataggtcacttttgtacctccggatttattttttgcgaaattctctgcaagattgaagctgtgctttttcccattcttcgcaacatagtctgcatagccaccaccatagttataagattgaataactacgttaatgtccgtcatgcctttggctttacaggaagaaagcagggacacaaaatatttacacccctgcttgatagaatcctctgtacttaatgagttcggcggtagccccagactttcactggactgcatgacatcggtagctgtaccgccactttccacctgtatgatagcaagcaggacgttcacatactccgagataccgttttctctggcgtatttttctaccattggctgatgtctgaggacatcggctgacaggttcatgccagaatagacaggcaaataactgttggaactgtcgtcatcttcgccggaaatcaatatcccgaaaaagagaatgatggagaaaaggacaggaaatatcgtacctatgataaggatacgctttaatctcatttcttccgtcctttctctggttgtttcgtaacagttttacgggcagatttcccattaacctgtgttttctgtaccgtagatttcttatgattgctgatggattccgctacgtttggcaggttcgctctggcaacagattttacctgctgttcctgtctgatattggttcggatagtttcttttccagccttgacttctgcattttttatcacaggagaagtagcaggacgcttcatatccggctttatgaccgtatcggtctgtgctgtttttggaacaggtgtggcaacagggcgttcatggcttctggtagctccggctgtcgctgatccattcgcatgaactgtctgtcttgcttcctgtgctttctgtaattcctgctttttctgtgagatattttccctgtgcaggttacgtttctgtgtacgctgttcctgtcggttttcccgttcttccacaacgccacgcttaaagtctgatacattattctttgctttctgtttcgcagagtgaacagcataaccagcctgtgtcggcaggtcttttacattttcttttagagaagaagcaccatcacggactttattttttgtatccatcacagcacctaccgcagaaccgacacggcttcccatgctggcagaggtattttcccgtttctttgacggttggttcgttgctggctttccggctctggcaacacttgcaccagccaccgcacctgcaacacttccagcaccgaaaatcaaagctagacaggaacggaatcgcttggtgctaccttatcgactacgagttgggcaggattcccgattttacgaaagggaatcaggtcacgccggttatttgcctagagacagggaaacgattcgagacgcaaagccaagcggaaatagagcttggaatcagcaggggtagtatatgtcgcgctctgaacaccggcaagaccgcgaaagggtatcactggattagagagagcgaatacagtgaagagaaagcagccgccgcgagagcggagggtgctccttatagagtcgtctgccttgagacgggtgcgcgatacaaaacctatgtcgatgcgggaagggacttaggtgtcgaagcaggcaatatccagcaagcagtaaaaagcaaatcacattatgcgggagggtaccattttgtaaacagcgatgaatacagcacgcttgctaaaggggaaatcgagaatatcctcaaaagggacggaagaagccgcactgtggtctgcgttgagaccggaaagcgctatgagtccatcaaagccgctacgagggagtatggagacagacaggaaagcgcccagtcggggattggcctttgctgtagaaatccctatcgcacctttgacggcaaacattggtgctatccagatgatttggagtcaagaatagacaatgccgaagaatatacggtaccgagaaaaacagccatacggtgcttagagaccgggaagatgtatgaatccatcgcagatgcttcacgagatacaggaataaacaacaactcgataagggcggtagcgcgaggtgatagacacaaggccgggggatacacgtgggagtacgtgaatccggtgcctgacaagcgcggtaacagagggtgcaaccaaccatcggcaaagaaggtgcgctgtgcggaaaccggcaaccagttcgtttcgctcggtgacgcagcaagggcagtagggttacgaaatggcaattcgatacgcagggctatcgacagaggtggcacggcaggaggttatcactgggagtacctagacgaaaaaaaggaggtgagcacagatgaccatcatcaagcagacgggcgtgcagagtaacgggcacatgaagaacctgcgcggctacatcaacgatgaccgcaaagtgctcgtgcgcgattccctcaacatggatggatgcaccaacccgaagcgttggtcgcaccacatgtggatgacgcgggagatgtacggtcacaacaagtcagcacggcgcgtgagggacaaaaagaccggggagcttaaggaagcgaagaacacggttctgttccatcagattctcgggttcaatcccgatgagtgcgacttaaacggcgggcggctctcaccggaagaatgcatgaggtatgccaaggagtacgtgggaaagcattacccgaaccagcagatagtgatggcgcttcacaacgaatactgcaaggcggacaagacccatcgctatgccgtccatatcgtcatcaaccgtaccgacctctccacgggcaagcggctcgatgaggggcgcgggaaaagcgccaaggtgaaacgtgccagccgcatccgcgacctcgaccacgagtgggggttgaaacaggtcgtggagggcgagcgcaattcctccgtccataagaagcaaccgtcccgtatcgagaaggaacttgcggcacgcggcatcgactcctataagacgaacttgcgagagctgtgccgtatcgccgccggggaagcggagaacatctatgattaccgcgagcttctggaatcatggggcgttgacacggagttcaagagggggcgcatgtacgttaccgacacggacaacaaccgctatgccttctccgtggcgaagctcgatgctgacctcggaacaaaggggctggaagctgcgttcacggcgaacgtggcgaaatccatccatgcggaaggaagcgcagccgttgcggagaagagggatatcgagcggcaaaaggcgatgggaacggaaacgaaggagaggtaccttgcgcaaattagaagcgtataccggaagtaccgcaaggagatacgcggtatggagggcatggaaatcgtggatatccccaagctgaaactcccgcgccccgattcggatatcgcggacgattcggaggtcaagcgcctgattctcgcctgttggcgcggagccgacgaactcagggcggaagtatcctcgacggtcatgccgaaaggaaagaagaacggcggaaacgccggaagcggcggttcccagcgggcgcaacaggcacctgcgcaggaacgcccggaaccgaacaaggagaacggcgagcgttaattaaaaagcggcgcgggcgggatattccgcctgcgccgctatacgggtgtgtgagaatcggcataaaagcgcccgccgttcccctaatgtcgcacatcagggagcagcgggctaaagcaagaaagtttctccacgaaggaagaaaacgcgtccagtttacctcactatgcgttcgcgtcaagctgacgcttgagattcgacaccttcaaccactggagaaggaaggcaatgggcgcgaatgcagccgggatggaaagaagaagcgtcgctatgaggagcagtccgagagcgttaccccacacgaacagctttgagcgcttgattgcacgccatgcagcgatgtagccagccggtaccgtgccgacgtaaaacccggtaaaggctgttgcagccagcaggacgggaacgagtgcaatgattccaattgcacccgtctgagttatcagggcaggggaattaacgagaagcaaaaggaaaacaactatcgcggttatcgtcccgacgatatagaggaacttcttcatcaaatcgaagactcgtttttcctcatcatattcggcgcgaattgccatggtgttgtcttggtatatcgggtgttggtaagttctcatgttatgaccttctttctaatgtcaattctaataagtctgttagtttgcatgacggacgaattatcgaccgttccatgtaaacagatataggtttacgagtctatcttactatattgctgggttgctttcaagctggtttgttgtcctatttgtgcgggatatatggagtatcggcttgaagatttatctggtttggtggtatgatatattaccagtaatcaagctagccgtaagaaaggagataccatggcgggtaagccacaggcggagaaagccgttgagcgtttcccggaactcgggtgtttcgcggttgcggtgcgccgcatcgtgtacgagaaggggatgacgctcgacaacgccatcaagaaaagcggaatcagtaaatccgcttggtttgccggaatggccggaagcgggggaaagccgacgcgtctgccgagccttgcatcctttttcgccattgcggacggtctcggaatcacgcccgaggaactaattgccgcgatgcggaaggaagccgaagtgcgtgagaagagcaatggggagagggctgagaacgatgagtttttcttttcccggcagcgtcaggttgatctcatcataggaagtgatctggcggatcagcttgttctggaatacctgaagtctggaaccgagtccgatgatgacgccggaacgtaccgtgtcacttgcctgcttatagatgcagtaggggacttttgccggatgggagaccggaagcaggtcaaagaggctgttcagttctttttccgaactcatggtcaggagtttgtatacctgtccgatattctttgcctccggtgggaatccctgatccacatagagaatcagagcttttaataagttcatctcggcattgtcccagaagtgatcgcctttggcagaaccggtattctggatgatgacatcagcaaatacctgtgccatggtttcctgtccgccaatttcacccagacaattccaactatccgagttttccgggtttacaagattaaaggatttcacgatatatccggcattctcaaggtaagtggctgtactttcgtacaattccgattttggatcggtgatgatgaggctttccccgcgggcaacacactggaagatcatgttgcgtgcaaaggcccggcttttcatggaaccgctggcaccgtaaacggcaatattccggttcatgcgggtatccttcgggagacaaacggcttttccgttcagttttccaagaatggttcccttgtgtttcttgacatcattcgtaagctccagtacctgatgcatttcctccaaagtcataaaaccggaagtcccataggttccctttgtggaataattcaggttccggccccggtctgttatttccccgtttcggtcaaatcccatacgcatgagaaggaaggtcaggagtccaaaagctgccagacatagaaaaatcccatacagattgtacgggaaagcagtcagggcatccagacaggcgagcgggtgcggggaggggatctgcggggcagttccgtttccggcaaaattgccggcagattcccaggtctgatagttgcggataaattgagcaacatagcctcctgcatagagggtgcagaaggtgatcggaagcatataaatgagcttccaccatttacggttcatgtaaaaacccccttttgaatttgcaaaggtcaatactggagaaatggattgtggcagttaagtattttttcaggaccggaatctgaaaatcgaaacagatcaggttcccggatctgccgtatacatttaagccggtattgaaccggttgattcgctgcatgtcaaaatcataagcaagaaggatggggttcccggaagcatccgtggcatcatgttccagtggaattgaatcgctgcggcagcccagatcggacagcaggaggttgtccagcttttccatgatctcagggtgaaccagcagttttaaaagcacttccccttccggagtattgggaaggtaatggaaatgctcgaaggaggtgtccagcataaacaggctctttttgtagcctccggtactggtaaacagccggaaagccatttccatgtcggttccggtcatgattgcccggatctgtggatgtccgttgtaagggtggccttgcaggtaatgctgcaggaaggcgtttaagcggacttccgttcgatattcccatttcaggactccgtttcccgtgttataaaggacatagacacattgcggtgccatcaggatgcccatgctgcgggagttcctaatcttcgtggtctccgggcccaattccttaatttctctggaagcgtaaaaaagaggaaggcttcgcataccgatggaaccagcttcgcggtgattacagaagatgtcaggttttacatccggataaaagggaatcccggcatgaaggagtgtcagatacgtttcggctttctgatgtaagcggatacgtcgggatacttcacttcggatgaggttcgtctcggtattgccggtcagatagcactggaagcgtagcggcgagacagataacagcatctctttcgcagcttttgtaagacggtagcctctgagagcatcccggtagtgggtacggatgaggtgttccgccttcaaatccgtaatgagtttttccgcataggaggcacttgggatgagtctgtttagctggtctgcgggaaattccccgcacatccctatcatttccagtaagcggtatttcgtagtgtcaggtcttatcaaataagcatcacctcaattcagttcttacccatgcaagcctatacttgggtaaatctccggtggtttggagataaaaaaagcaagaaaacaaagttccctgcggtggttcttaccgatgtcggatttctgcctgagaagtcaggagattttccgacatgctttcgtgatgatttttctggttctgcagccatttcggaaagtcagctttttccataaccgataataatactgctccgtctaaaacggataaagaacggtatacttccgccaaaaaatccatatggcctggcgtatctataatgttgacttttacatcctcccactgaaaagatgtcactgctgtctggatagtgattcccctttgacgctccaaattcattgtatctgtccttgttgtgccttcatctacgctccctggttctgcaattgcaccactggtatataataaactttccgttaatgttgtctttcctgcgtcaacgtgagccagaatgcctaagttaattattttcatgtgattttcctcctatcaacacccaaaaaagggcataaaaatacccagtgataaatactcctatcactgggtaaataactccaatagccccaaaacacttatatgttttcgggcatataaaattacatgataaaagtattcttaaactgggtacaaaaaactaagccccatattaaaagtgaaacgggactgctactttttgttcccactatcaaattgacagtttatttaagaataccttgccgcatatttattaactccttgtataaaactgaatctaattatattccttaaccctttatttgtcaagctgacaaactaaagcagaaaaagcggcaggatttcaccctgccactaatcatctgtttatgcaaaaataatttccttttccacaatctccctcgcacaagcccttatgttattgaggcatcctgtccattctaaggcgttttctgcctttagctgttccgttatgccctgtgcctgtttcataccctctatgagcctttcaaagcgttcctgtgcctgtctgtcaatgtcggcaaggtaagcgttaagtctgccgcttgtaagaagattggtgtatgtaactttacagtgatgcttcagataatccaaattccgctgtccccagatgcctatcggctgttcttcttcgattattttttgtcacaaattaattataacagaaagaaagaccttgagttcaatataaactcttggtctttcttttttcgggactattcttttttcacagcccctttttttgaaatattgtcttgaatgaatatttcgcatttgtttaaaaattctttagaaatgccctttctatatcttaacaatctcctgttaaactatgctcataaaaagataacgggaggaattaataaatgagagtattgattacaacagactggtacgaaccggttataaacggtgttgttacttcagttatgaatctttccagacagctaagagaaagaggacatgaagtaaaaattcttacattatcaagaacatttcattcttatatagaaggcgatgtggtttatgcaggatcaattggacttggatgcatttatccgcaggcaagattaaaaattccaaaggcagcaggtgactatatggaaatgttgcttgagtggaaaccggatattgtgcattcacagtgtgaattttccacatttttcttagcgaaaaggatcgcatctgaacttcacgttccgattgtacatacgtaccatacagtttacgaggactatacccattatttttcaccgcagaaagtatggggaagaaatattgtgcagttgatgacaaagaaacttgcaaatgtggtagaaaccctaattgcacccagtgataagatccgtaagatattggaaggataccaggtgtcttgtccggtggaagttattccatctggaatccatctggaaaaatatcagttatgtaaaaaagaagactggcgtaaaaaaatccgtatgcagcttggtatatcacaggatgcactggtgttggtatatgtaggcagaatggcaaaggaaaaaaacattgaagagcttctggaatatcagcaagatgcaggaaaatccggggtgattttagtccttgtaggggatggaccatatcttccggagctgaaaaaaaaggtcgaagagctaaagcttgctaaaaatgtgatttttacgggaatgatcacaccggaagaagtgggacgctattatcaggcaggagatctctttgtcagtgcttctatcagcgagacacagggaatgacttatgcagaagcgcttgcaggtggtattccgctcctttgcagaagagacggatgtctggaacaagttgtgacagatggggaaaatggatggcagtatgataaaaaagaagattatcttatgagaatccaagaatggaaggggatgggtgaaaatgcaagaagcaggatgcaaaacaaggctgctatttcagcagaaaaattttcttctggaaattttgccgaaagagtggaaaaaatctatgaacagcaaatacgaaaataccgatatgaaaatgcagcctaagaaacagagaaatctgactggatttttcaatctgctttcgatagccggactggccggatgtgcgcttcttgcaatcttggcatataagaacggcattttaaattcggtagattctttgcagacatttatctggaaattcggttatactggaatgctcgtttttattctgatccaggttgtgcaggttattattccaatcctaccgggtggagtcagttgcctggggggtgtgatcttttttgggccgtggctaggatttctttataattatattggtatctgtataggatcaattgcagtgtttggaatttcaaagacaataggaaggccggttttatacaaaatgttttctgaaaaaatgatagaaaaatatgatggatggacccagaaggacggtaagtttttgaaattatttgcgctggcaatctttttcccggtggcaccggatgatttcttgtgctatcttgcgggaactacaaaaatgacgtggaaacagtttacagcagtgattgtacttggaaaaccattttctattgcactttacagtctggggcttacgacagcatttaagatgttattttcattataaaaggaatagggtaaagattatgaaaacatatatatacagaggtgggtttccgattgtagaaaaaagtggtgtcggaaaagcaatcgagcatcaggagaaaatgctgaatgcagtacaggcaccgcgtgcagccaggtggaaagaagcaaccgtggttcatatgaatacagtttttccagattctgtgattgcggcctttatagcaaaaatgcagaagaaaaaagtgatttattatgggcattctacaatggaagatttaaaaaattcctttattggttctaatcttgcagcgccgatttttaaaaaatggatctgcttttgttataatttgggggatgttgttgtgacgccaaccgagtattccagaaaattgttggaagggtatggattgaaacgaaaaatttattcgattactaatggtgtggatacagaatttttcaaacctgatccagaggggagaatacgcttccgcgcaaaatatcagctaacggaagagcagaaggttgtgatatctgtgggacatttgattggaagaaaaggaattctggattttcttgaactggccagaatgatgccgaaagtacagtttatctggtttggaggcggtaatgaaagcctggtgacagcagaaatcaaagaggcgatatcaaagaaaccggataatgtattgtttgcaggattcgtaaagtctgatgaactgcgtgatgcatattgtggggcagacgtattttcgtttatgagttatgaggaaacggaaggaatcgttgttttagaagctcttgcctgtgaaattccgacaatagtaagaaacattcctgtgtatgaaggatggcttgaagatgaaaaacaggtatataaagcagagacaataaaagagtttcaggaaaagataactgcggttttcagtcgggatgttcgtttgatgaaaaaggaagaacggaaaattgcttgtaataaaagtcttggaaaagttggagaacgattgctgaggctatattctgaaatggaataagggacgttcagccgcgccattcgcaaaagcgtgcctgcggcacttgtcgctgctgcgcagctattttgctcatagagtggcgctcatctcatccgtataatcagccgtcttttcatgcgagcatgaaatccgtctgactatacggatggctgaactgatgtcagaatattctgaattgcgcaaaatataaaaacaacattgacaattctggaaaggcgtggtaagataacattcgttcgctggtcgagacagagactaaggagtggcatgcagaggcagagcggatgaaaaataaaaaagctgttgacaagggtggaagtgcagtaatgcatggagctgactgttactaatcggtcgagggcataaccaagaaggtaggacagggtaaagaatggatggagtagagatttaaatttgtatgtggttttgaaggtacatgtagaaagtaagggagctgtagaccgtaagggtttgcagtttttttattacatatattacataggaaattatttacctttaaggaaaaatgtggtaatatgctgaaagaatgagagtaatttaagaggcatgagcaaatgggttttttaaatcagctattaaagtacaaaaatatatgtattcaatgtcataacagtccagatgcagatgcactggctgcggcatatggggtgtatacatatttaaaactacaggatatcaatgtgtcaattatttacagtggagattatgaaatccaaaaaaaagatcttttgtacatgattgatatctgtgagattccggtagaatacgtaaaagagttacccaagacagatcttctactactggttgatgggcaatatggaagaggaaatgtatatcgttttgaagcggataatatagcaatgatcgatcatcatatgccttccatgaaaaaaacagaaaatgcttttattgactattcttatcaaagctgttctacaattgtctgggaacttttgaaagaagaaggatatgatgtaaaggcgaatgaaaagttaagtattgcatttttatatggattgtatacagatacttcttcctatgtagatttgtacaagaagcatgacattgcgatgcgcgatgagttaagcaaagattatccggaactggaacggttaaaaaaatcatccatgagtctggaggacctcatgattgcaggagaagctttgtaccatgcatattttgataaagagaagcaatatcttttgatcagtgcaatgcattgtgagcaatcagtgcttggaatcattggtgatatggcaataaaggttgatgttgccaaagttagcattgcatatacggatattgacagtggatatcaggtttcaataagaagtgcggatcgggagtatcttgcaaatgaagtggcagaaaagctctgcgatggaatcggaagcggtggtggccatatagataaagccggcggtgtgatttcaagagattgtatctgcgaaagttatgcaggatgggaaattgcagacattatcaaagagagaatggaaaaaatcatgaaataaaaaaagaaacagtggtttacaaaaaaggaagtaaaccgctgtttctttctataatgatgttagaattccctgttctgatagaattttatggatagaatccaggaaatcatatacagtaataaacctatgaaaaaaagaatcaaaatatagtaacttcggaaagggaaatgtgcaagtccgagaggcaaattttttatgaaagattgcaaccaaccaagcaatgcgaaaaataaaataaatccaatataataagcaaaccgacctttctcagcacctagtttgaaggtaaacggaaacataaaggcaggtggcagtaatccggctataaagataattgtaaaaatagtaagaagaccggaaatataaaagttgtgtcttataatcatgttgattatttgcacaatttcaacaatgatggcagaaagtgtaagggtacatactgttaaaatatatttggaggatacaatttcttttcggctacagggaaaggtacaggcatagagactccaatttgatttttcatcgtaagaaagcaggtttaccgggataatgctggaaattgtaataggatataatgcaaaaaacagattgttattccatgctccggcaaaggaaaatacaataatcagaataaaaaataaacgacaatattttatcatcagataaagatctttacgaagtaaccctttcatattcagtgaaccccctttatcataaaaataaacaaatcttctatactgatcggatgtaccttaaatccttccggaatctgatctcgaagaactactgcttctacattgtaagaagagtatttgactccgatgaccgcagattgatcgagttcctgaagctgttcctttgtacattgaatgataccgtatttttccagaagccggtctttttcttcgaaaagaacaaggttacctttatgaagaaaggcaacataatcacaaattttctccagatcacttacaatatgggaagaaattaaaattgcatgagattcatctctggtaaaatcattgaaaatatcaaggatttcatcgcgcattacaggatcaagaccacttgttgcttcatcaaggatcagaagtttaggatgatgagagagagcaactgcaattcccagtttcatcttcattccttttgaaaacttaccaaattcttttttatttggaaggttaaatttttggagatattggtcgtatagagaagaatcccagttgtggaaaatatccttcataatgcgtccaatctgtaaaggagtcaggcattcctgaaaaccaacttcatctaatacaacgccaatttcttctttcaagaaagtagtagcagaagtgcagtctcttcccaaaattcgaatcgaaccgctgtctttttttatgatatccagaattagtttaatggtggtagtttttccggcaccattttcaccgatgagtcctaagatacatccactgggaagagtgagatttagatgattcagggaaaatccaggatagttcttattcaaatcgtttatttctaaagcatttgtttcaaatgtggccataagctattcctccatcatgaaatgaagcatctcagtaagttcctgttcgcttagattacaggaagctgcaagatgtactattttttccatgtagtcttcaatttttttcagatttgtttcacgcaaaagatccgtattaagtggagcaacgaaacagccctttgctgcaatcgtgtaaataaaaccttctttttccagttcatcgtaagcccgcttggttgttacgacactgattcgtagatctttggcaaggcttcgaatggaaggaagagcttcgtcagatggtaatgttccacttataatttacgatttgagttgtgtaaaaatctgttcatagatgggtgcaccacttttgttatctatgaatatattcacgttttcacctcgcttaaaatgttataagggcgtgtgaaaaaacgagagttttttcatgcgtccttttgcttatggttataataatagttatattacataaaattaccctgtcctaccttcttggttatgccctcgaccgattagtaacagtcagctccatgcattactgcacttccacctctgccctatctaccttgtcgtcttcaaggggtcttacaacttgcgttgggatatctcatcttgaggggggcttcacgcttagatgccttcagcgtttatcccttcctgacttggctactctgccatgctcctggcggaacaacagatacaccagcggtcagtccagcccggtcctctcgtactaaggccagctcctctcaaatatcctacgcccacgccggatagggaccgaactgtctcacgacgttctgaacccagctcgcgtaccgctttaatgggcgaacagcccaacccttgggacctacttcagccccaggatgcgatgagccgacatcgaggtgccaaaccactccgtcgatgtgaactcttgggagtgataagcctgttatccccagggtagcttttatccgttgagcgatggcaatcccactttataccaccggatcactaagtcctactttcgtacctgctccacccgtcggtgtcgcagtcaagctcccttctgcctttgcactcttcgaatggtttccaaccattctgagggaacctttgagcgcctccgataccctttcggaggcgaccgccccagtcaaactccccacctgacattgtcccccagccgggtcacggctgctggttagaaatccaatactgcaagggtggtatcccaacagcggctccgcatcaactggcgtcaatgcttcttcgcctcccacctatcctgtacatacaatatcgaatcccagtatcaagctggagtaaagctccatggggtctttccgtcctggcgcaggtaaccagcatcttcactggtatttcaatttcaccgggtgcattgttgagacagtgcccaaatcattacgcctttcgtgcgggtcggaacttacccgacaaggaatttcgctaccttaggaccgttatagttacggccgccgtttactggggcttaagttcaaagcttcgcttgcgctaacctctccccttaaccttccagcaccgggcaggcgtcagcccatatacttcaccttacggttttgcatagacctgtgtttttgctaaacagttgcttgggccaattctctgcggccagctctcactggcactccttctcccgaagttacggagtcattttgccgagttccttaacaatgcttctcccgtcggccttaggattctctcctcacctacctgtgtcggtttacggtacgggtacagtacaaacaatagcggcttttcttggcagctggctcacacatttccctacttcagttcggtatgcatcacgtcttcggattatagagcggatttgccaactctactcctacctcgcttgccgcgggattccattcccgctagtgctctccctctgcgtccccacagttctgttatactgcagtacaggaatttcaacctgttgtccatcggctacgtctttcgacctcaccttaggccccgacttacccagagcagatcagctttactctggaaaccttgggtattcggccggaaggattctcaccttcctctcgctactcattccggcattctctcttcttaaaagtccacagctccttccggtactgcttcttccctttaagaatgctcctctaccaattaactacgttaattcctgagcttcggtagtgtgtttcagccccggacattttcggcgcaggacctctcgaccagtgagctattacgcactcttttaatgtatggctgcttctaagccaacatcctggttgtctttgaaatcccacatccttttccacttaacacacattttgggaccttagctgcaggtctgggctctttcccttttgactacccaacttatctcgtgtagtctgactcccatgaatcatcttactggcattcggagtttgatatcctttggtaagctttgacgcccccgcgggaattcagtgctctacctccaaaagactctcatgaggctagccctaaagctatttcgaggagaaccagctatctccgggttcgattggaatttctcccctatccacacctcatccccacccttttcaacggatgtgggttcggacctccattgccttttacggcaacttcatcctggacatggatagatcacccggtttcgggtctactccatctgacttaacgccctattaagacttgttttcacttcggctccattccttaagaacttaacctcgccagatggcgtaactcgccggaccgttctacaaaaagtacgcggttcatcatataaagatgttccacagcttgtaaacacagggtttcaggttctctttcactcccctcccggggtccttttcacctttccttcacagtactatgcgctatcggtcactaaggagtatttagccttacggggtggtccccgctcattcccacaaggtttctcgtgtctcgtggtactctggatcccgccttgctgactcgtctttcgcttacggggctttcaccctctctggctggctttcccaaaaccattctgctaaacttatcagatcaattacgcggtccgaaccccggaatgcacgcattccggtttgggctcttccgttttcgctcgccgctactcacagaatcacttgttgttttctcttcctccggctacttagatgtttcagttcaccgggttcccttccatacgttatggattggcgtatggatgactggagtctgtccagccgggtttccccattcagatatctccggatcatcggatatttgctcctccccgaagcttttcgcagcttatcacgtctttcatcggctcttagtgccaaggcatccaccctgcgctctttctagcataaccaactcccttctcccacgggaatgggatccggttacacatgcatagcgttgcatgcgttggtatttcaggtcgtttttttacttcgttttctcgaagatgtaagttaatcattaccttgcggtgatgatcacctcggatgtctttctctatttgagaattgatttatttttgtatgcagttttcaatcccttcttctgttatctgatttatagaaacttattaacctagtagtcttgattgactacatcattattatactaggagaaatccttttctcaaagggctttttctatttatacagatattcgcaaactacaagataaagctaaaacttcatatactctaatcacagaggaagtggaggttttgatatgagtaacagtttagcagaagtacacccggagcttgtttcggagtggtcggagaagaacttaccgcttacacctgatgacattactttcggttcaaataaaaaagtatggtggaaaggtgcttgtggtcacgaatggaagacaagcgttaaggctcgttccaatggagagaaatgcccgatatgttccggtgcgagagtgattgcagggattaacgatttggcaacattagagccgctactggaaaagcagtggtcggaaaagaataagataaaatcgacagaagtttctattggttcccataagaaagtgatttggagatgtgagaaaggacacgagtgggaagctgctgttaagagcaggacaataaataaaacgggttgcccgtattgctctcataataaagtgttggcaggatttaatgaccttgcaatgtttctgccggatatagctaccgagtggtcggacagaaattatccgacacttccaatgcaggttgcggtctttgccaatcgtaaggcttggtggaagtgtaaggattgcggcagagagtgagtgaaaaataatctaaaaaataaattgtgacacaaagctgaaattataaaaaatgttttttcgaatctgcagaagtcctggatttcttttggaacttgatacaaaaacataatactttttgtatcaagttgattttttgaactattcgtgtataatagaacttgatacaaaaactatcaagaaattgtacgaagttatttaaggagatgtgcatgaatacggttatgaattatgaatcaatatttgaacgatatggaggaataatgcgtacctgcgaacttacaagggaaggtatatcttatcaggtacttcaaaatctaatagaacaaggaagagtagaaaagatcaagtatggttattatcagtggcaggatgaaaaggcttttacagaagtgtcagtaataacggcactctttcccaaagctattatctgtgacatgtcagctgcgatgtattatggttatacggatcgtgtgccaggagtctggcatatagctgtagataataagtctgcaagaaacaaattcaagctagattttcctatcataaaaccacattttattgaaacatccagattgaatattggtgtgagtgaaggaaacatagatggaattacggtaaagatttatgacagagagcgtgttgtatgtgattgtttgcgtcatgttaatacgatggatggagaggtctttaatattgtaatccaaaggtatattggtgataaaaagaaagatgctgcgaaactaatgatgtatgcctcaaagcttggtgtggagaagaaagcaagaagggtgattggaatatggctgtaaaagagataaaagatatgggtgcatctgtgctcaccagattaaagaaacaggcaaaagaaacagaaatcaactatcagacttgtcttcagctttttgcacaggaagagtttcttcgtaaacttgaaatgtcaggatatgcagagaatcttgttttgaaaggtggaatgttcttatacactatttcaaattatgagggaagaccaactatggatattgatttcatgctaagaagaatgtcgaatgatgtagctggaatgaaaacgatcatggaggaaatttgtcaaacagatactcacaatgattttattagtatggaagtgctaggaacgaggaaaatcactccggagaaaaagtatcctggtataggtataaatttgatggctcatatcaaaaatgtgagaattccattttctgttgatattggtgtggatgacgtgatagtacccggtgcagttaagcgaactgtggcaactagactggaaggttttgaggaaccaaatatttatacatattctttggagagcacaatggcagagaaatttgatgccatcttaaagagaatgactgcttctagtaggatgaaagatttttatgatatttattactggtcgcaggtatttgattttgaaggcagggtgttgcaggaagcaatttttgaaaccttgcaacatagaggaacgccatacgagaaagatagcatggaacaaataagagcatttgatcagaatgaattccttcaaaaattgtggaataattacaatcccggaccagggcttgaaaagcctgatttttcttctgtattggttcagattaaccggtttattagccctgtatatggagcactactgcgagaagatgaatttttggggatgtggtcatcgaaagaaaacgtatggaaataacttgtttaaaaaaattgcatatcagaggctgtattttcaccctccttcttttgtatatatgaaagatattttttatgtacgaaggaaggaggttttttcatgcctaaagtcagaaaagaaattccagaattggaaaagctggtgcaggtcggaagaaagaaatttgtccgttatgaggaaggggcacaattatattctatggggttgcatacatttcaggaattagcgaaagatgcaaaagcagtctatcatgtgaagagagttgttctggtcaatacagagattgtggatgaatatcttgagaatttcagagatgaattataaaaaataaaatgtaatacatgaggagcaaaatacgttaacttgttgtcggacataaagtataatggtgttgtaaggaaggaggaaatagtatggcaaaaaagaaatgcacagttcttagcttatcgtgaactgtgcagttttgtaaataaatacttttaattagccgattacggcatcctctgctgtaaaatgttccagagaattttcttttaccctgcaagggaagctaagaatcttacacaagaagaattggcagcactggtaaacttgagtccaactcatgtaagtgttatagagagaggactgaaagtaacaaaacttgatacttttattgcgattgcaaatgcattagatgtttcagcagatacactattgattgatgttgtgacacattcggttagcggcgttacgaatgaattatctgaaatgatagagaaactacctaaagaaaagcaacagagaattatcaatgcagtgagagcattggtggaataaatacgtgaataagaagatggaagggcttattgctcttcttttttatttggtttaacgtgaaaatatgatatagtagttctaaagacttatatataattctaaggaacttgataaaatgaagaaaaaaaatataacacttgtatttgttgctatcgttttttctattattgttggaatgataattgggaaaagcttattaaagcataaagaaggtgagccagatgtagttggcagtttttctatgaatagagatgagaatcttacagtagttgctaacagaaaaaatatttctgataaagaagcatttacaagactgcttttaaaaatgtacaaagagaattcatttcattcaataaaattttctacagatcatggatatgcaaccagccttgatatgaccgtatattcttggaaagaagatatcgaaaatggaaaatccattatgcagatagaatttagaccgattgaatatggaaaagattatgatattgttcataatccggataaatatgtgctttttatcgatggaacagaaataaaatgaaatatatagatatgcagataaagcgcagaaaaagaggattgctcaacacaggaggatattttcaattaccctcaaaatgataaaagcgaggcagcggaaaatccgttgcctcatatcagtattatgacaattaatctagttccgcccctaactcatacctccaatactccgccgcctcatattccctaggttctgagagtaccggtacagtaaagagttcaaccggaacaccgagtgttgatgcaaagattttcataagatcctcttttggtgttcggacatcgctttcatactgagcaatccggacatcagcacagctgtcgggaaatccaacagccatgccaagttctttctgggtgagatgatttttctgtcttaagtgttttaattttcttccaaatgtaatcatagtattattctcctgtgcttccaaaagccccagttcctcgttcttcaccgagatccaggacaaagtctgcaatcacaaccggtgtgatcaccagctgaccgacgcgtgtgtctttatgaatgatctgagaagatgtgctcacgttgctgataatggcatggatctcaccacggtaaccggagtcaatcggtggaagttcgcataccagtccttttgcagccatgctgcttcgtggaaagacatatccggcaaatccatccgggatgatgagaccaaatccaagcggaattctcgcaacttcgcctggctttaatacgcaatcataaggcatgaatacatccgcaccggcatcattttcatgtggccggaagggatgatgatctgctttcagaccaaagtcaatcagtttaatctttatgggtgctcacctccttcctgatgagcaatggataatctgcttttaagatatctgacggtatccaaagctttgaaataggattctggcaggacatctgtttttccatgcagcttcctctctgacagaatggaccggtaagatccggtgcaaaaaggattgggcttaatttgtacaatctttgccagatctgtagcatcacaatccttgtttcatccgtatttcttcggcaggttctttggccaatcatatgcttccactggtaaggtgtcgcactgatgatcagtacgtttcgaagtccctgaggtgtggcatatccggctgaatcatgatcaatgcctaaggcacaaagctctgcataatgatccagatctgactgacagcttttcttgtaaatatcctggatttctttatctgctttcatgattccatatggaatagcaaatgcagcatgaccggaataattgctgtactgcagagatgcactcatgtactttacttcgttctgatgtcttgtgatctgtgccaggaagcgtctgcttgcaccaacaacagctacggtaatgaccatgaatttctgcacggttggatgcggaagccctgcaatgttttctacagtcttctgactgtaggattgacggtaaagatccatcagatctgccatgttctggatcgtatgaccgtgttgtgtgagtctggcagcaaagaccatattctgttctgcttcccggattccatagcagtttaagatagctgtttcaatgtgatccataggcctgctcctcctttaccagagcttttaaaaggatcagataattgatgcagtctgtgattttttcatcccactgttccatgtcaaaatgtaacagagtggaataacacatatcgtaaagggatacgacatgtttcgacatcataccggccagtgctgcttttggatcgcagttttgtaaggcggcagcaatcttgaatgcactgaggcggtcaatattgtcaccggtatattctttctttttatgtgccagaatatcggcacactttctcatctgaagttcaaatacaatattaaattcttcttgtgtcatgtgatagttcctcctttgttttgtgatggttatctttcgagatccttggtttttgatcttactggttccggaatctgcatctgaagaatgaaatcaacattctgatcggcagtatccagatcttttaatttttctttcaagctgcttattgcttcttcttcggaagctatctgctaaccgcctccgtgtaagaggataattacatcgctgttttcttttccatattctacataattcaacctctttcacctcgctgtaaacttccgatttctattttcgtttccatagcatagtgtactctttttcaccagtagtttcatccaagccttcacattgaataatgaacccttctcttttgtaaaaagaaattgctctggcattcttctggtatacatttaatcgtaagctaacttttttatccttaacataatctaataaaagcttacctataccacatgactgcatttcatcggagacaaaaataccttctatatatttatcatttagtcctacaaatccttgtatcattttatctgcttcaaacacataaacttcgtattgtgacatcatttcttttactaattcataattacttttccagtattgattggaaataaaataatgtgctttcagatttgtctttaaccatatgtcagcaactctatcgatatctccgttcagcaactttctaatcataacaaattttctccacaactacatcctttatgcttttctctttttttcattctatcacaagctcaccattaatcatcattttttttgatgttttttcttttcccccactgtaaaacagcctctgagcgtttcgttatatagaggggtacacatacagagcaagatccacccatgtttaacagtattgccatttggcatcctgttctcctatgggatttatcttgatggggatctccccataccctctcaataacagacgtttcacttgtctgttggttccacctaaaggtgttcacagcactatttctaatatcggaagggacagccgatattgaaatacgtggattcccggcgggaggaatagtctcagcgaaaggaggagtatgagaacaaaaaacaaagataaagaactgaatcacagacattttataggattacgtcttacagatgtcgaactggatttattagaccaaggcgctgcttgtttatctgttagccgatcagaatatctgaggaaacttctattggaaaagcaaatccatcatcagattgaagttgttgcagacatgaacgacctcagaaaactggtcagtgaatatggaaaaatcggatcgaatctcaatcagatcgccaagcattttaacagtggtggcagtcagtctcgtgctatagaaaatgaaatccatcagtgcatcacggacttattcctattgagaaaagaggtactgaaactggcaggtggtatgaatggcaatcgtaaaacacattaaaagcagaaatgcaaattactcggctgctatcaattaccttctgtttgaacatgatgaaaaaaccgggaaaaagattgtagatgaatccggacgaagcatcctacgaaaagagttttatatggatggactgaactgtgatccgatgtcttttgacaaggaatgtgaattgacaaatgctcattttcacaaaaataagaaacgtgaagatatcaaaagtcaccactacattatcagctacgatccagccgatgttacagaaaacggtcttaccggagagagagcacaggcaatcagtttggaccttgcaaagcagatgtttcccggatatcaggcactggtggttactcatactgatggtcacaatgaatccggaaatatccatactcatatcgtcatcaacagtgtgcgaaagactgcagtggaaaggcggccttatatggataaaccacatgaggaagccgccggttacaagcatcgatccactgataaattcatgaacacttttaagaaaaccgtcatggatcggtgccaacaggaaggacttcaccaaatagatcttcttgcaccggctgagaaaaaaatcactcagaaagagtatatggcacagaaacatggccaacaaaaactggatgagatcaaccagaaaatcatcgaagatggtctcaagccaacatccatcgtgttccttacacagaaagaatatttgcgaaatgcaattgatgaatgtgctgccacatccaatagttttgatgaattccaatccaaacttctggaacaatttcaaatctctgtgattgagcatcgtggcagatacagctatcttcatcctgatcgacagaagcggattactgaacgtgcactgggaacacgatatggaaaagaatacctggaacagaccttcttacgcaaggatccattggccattctctacatcagatctcacctgcgcctggttgtaaatctccagacaaatgtgaaagcaatgcagagcccggcttatgctcatcgggtaaaactttctaacctgcagcaaatggcaaataccattatctatgtgcaggaacatggatttgatacgcagtcagatctgaaaaacacactgcttgcctcaaagcaggaactaaaagaaatgcagacacaggttgctcagcatcgttccgatctaaggatcctcaccaatcagatccgttataccggacagtaccatgcaaataaggaagtttattcccagttttcaaaagcaaagtacaaaggaaagtaccggaaagaacatgcgaaggaaattcagaaatatgaagaagccagagattggctgagatccttttatcaggatggaaagatgacaagcctaaaaaccttgactttacaaaaagaaaaactgcaacagcagatagcttccgaagaagaagcaataagcagcttgaaagaaaaattaaaagatctggatactgccgatcagaattacttttatgcgaatcaagacagattacatgggaaatgaccatctgcttccggcttataatgtacaggttggtgttgaatttgcaggcgaaagtgagccagtctttgaaagagataaaaataaccgcagggtcttagccagacgaagctataacctttattctgacgtacagaaaggcgaaaatgttgtggtagaaattcccgtgcaggctggcgaaaagaagttccagtatgaacagaaagtaaaaattgtcaatccgaagttatacggcagaggttacgcaatcggggatatgggacataccgattatgtattagttgctgatgatattgtagcagttgaagaaaagtaaaggagtgaagaatttatgagattatcaaacgggtttgttattgacaaagagaaaacatttggagaattaaaatttacagcggtgcgtgatgtgttcttacagaatgaggacgggacaccgagtacccagcttaaaaagcgtatctatgatttgaagtgcagtctgcatggtggaattatccccgtgtctgtaccgccagaagtaccgttaagagaatttccgtacaatgcagttgtggagcttgtcaatccagtagccgatacggtatcacgaaaaacttatacgggtgcagatgtggactggtatgtaaaagcagaggatattgtgttgaagaataaaggaaaccagaacgcaggaagtccacagaaccatacaccgcagggacagccgaaaaaataggattgctggatagattttcattgtagcgaatacatggaattgctataatatgagtatgtagaataaataaaattttaagaaaaattttcgatttttcgttggataatttttaatttttgctgttatctttatagaagaaacggactgacaaatatatgtaatgagttcatgtaaaaggagtgaaaaatatgttgccaatttccgatattcttattcgttcaataagtgggtatgtgtttataattccagttcttatattgtatttttttattagaaaaaaatcgggacgaaaacaaagtatttttcatattatcgctgtgtttgttttttgttattatttatttggaattttaactgtaacaggtattggttatacaagcacaatatcatttcgtccccaaatttctataattccattttgtggtatgataagtggaccaatagataccatactaaaccttgttttatttgttcctttgggctttttcttaccattactgtataaaaagtatcagcatataaagaatgttatcttaactggctttctgttttccttatctattgaaattgttcagatgtttggctggggggcaacagatataaatgaccttattataaatacagcaggagcatgtttaggatatttgatatattatctggtgtcaaaaattttacctatcaattttaggaaaaggcttcagtccgaaaatgttaatgacatggtcgaaataatgttatatgcaatttatatatttatagttatgattacagttcaaccatgggtaattcatagtttactcaatatcgggtaaaagtgagtattgattatgcttcaatcaataaaattgcaattttgcaacttaatattactacaaatagagcagttagtcttaaagattgactgcttttttcatacccagaaaggagtgattgatttatgcgtaagatttggaacaaaggacaccgtatcagagccagcgacaagcaccttgtctaccacttttccatagggacgcttctgtttgtattcgtggcggttcttctgctactgaatatgaaacagctcatgcgtaccgattgggagcatttcagcttgttagagaatggcttgacgctttccccttacaacttcatagccatactgatagcgactggtgtttgtgcattggtcgcttttctgtattaccgcttctgttacgacggtttcaagaagctcctgcaccgtcaaaagttggcacgaatgatactggaaaataagtggtatgaagccgataccgtacaagacagcgtttttttactaacctgcaaagcagatcaagggaaaaaatcgtctggtttccaaagatttattatcaaatggaaaagggactgcttcatatccgctgtgaaattacgctggggaaatatcaagaccagcttttacggttagaggataaattggaaagtggcttgtattgtgagctgaccgacaagaccctgcatgacggctatatcgaatataccctgctttatgatatgatagcgaaccgcattaccattgatgaagtacgggcagaaaacggctgtcttagactgatgaaaaatcttgtctgggaatatgacgcactccctcacgctctgattgctggtggtacgggtggcggtaaaacctattttctgctgacgctcattgaagccttactgcataccaacgctgtcctttatatcttagacccaaagaatagcgaccttgccgacttgggaacggttatggaaaatgtatatcataccaaagaagaaatgatagattgcgtcaatccgcagagcagaaatttatcgtgcatgacagtttccgacagcttatcgcacagtcccgtgagggtaaaattcatgtggaaataacaggaaactgcgtagtagaagtctggaggaaaagacatgaatgcggaagaacgaatgacaaaaggacaattagaagaagaaatccaatattttcggaagatctttcaggagatccgtcttttcccaattggaaatatatcagatattgatgaagaatggagaaaaatcaacgaggggcagagctgctatcattattggaaacgggaaacaccctgtgataactgtgtagtgatgcgtgcagcgaccacgaaagaagaaaaaggaaagctggagattgtaaatggcagaatttatcaagtgatcgcacgttatatagaagtggatgagaagccatatgtgatcgagctgatccgttgcctggatggtgactggtcgattggagagattaatcatgagcgtttgatagatatatttgtacattacaatgacaagctatacagagatgcagtgacagacgcatacaaccgacggtattatgaggatgagatgaagaactagaagaaaaatgccggggttgcactgatcgatctggatgattttaaactgcataatgatatctacggacatcaggcaggagacatggcactctatactgttgtagatatcatctggaaaaatatccgaaagacggataaactgatccgttttggtggggatgaattccttcttgtgatgccggaagttacggaagaagtttttagtcagaaactgcaattgatacaggagagtatctataatacaaatgttccgggatacccgaatttgcgactttctatcagtgcaggtggcgtgctgacggaaggaggcagtattgaggaagccgtgaacagagcggacaagctgatgtatcaggcgaaggctatgaagaataaagtggttacacagaaagataaaagagagcagtacgggaagcagatccagattaaacagcggattctggttgtcgatgattcaaagatgaaccgtgagattctctgcgagatgctgaaagatgattttgagattattgaagcgacgaacggacaggaatgtgtttcgctaatagaacaatacgggaaagagatatcactggtactgcttgatatcgtgatgccggttatggacggttttgaaattctgatgtatatgaaccggaatcactggattgaagatgtgccggtaattatgatatccagcgaggaatctgagaactatatccggaaagcgttcaagtttggagtatccgattacatcagcagaccttttgacagcaaggttgtataccagcgtgtatttaatacgatcaagctgtatgcaaaacagagaaggctgatttccatggtatccgatcagatgcatgaaaaggaaaagaacaatcagatgatggtagaagttctaagccagattatggaatttcgtaatggagagagcggccttcatgttgtccacatcaatacattgacgagacttcttctggaaagacttgttgagaatacggatgcatataatttgacgccggatgactgctatctgatttcaacagcatccgcgtttcatgatatcggtaaggttggaattgatgagtcgattctgaataagcctggaaagctgactaaagaagaatttgagactatgaaagagcatacgctgattggtgcttctatgctggataagctggagcattataaggatgagaagatgattaagatcgcgtaccagatctgcagatggcatcatgaacgttatgatggtaaagggtatccggatggtctgaccggagaacagattccaattgcggcacaggttgtatctgtggcagatgtttatgatgcactggtgagcaagcgtgtatataaagatgcgtattcacatgagcaggcgatgaagatgatcctgaacggagagtgcggagcgttcaatccgcttttaatggaagttcttgtggaaatccaggataaaataaaagaagaaatgcattacgaagtataaaaaagaagaaatgttcggcagaaacgtccgccatgaaaaatcagttgtatttccctaacgaattgtgtataataaataaaatattcattttatataccaaaaataagaaaatgaaagatgaagaggaaaatctttcaatcctggaggggaataagggatgttatctacaattgagtcggtcaataatgtagtcaataattttatctggggtgtgccggcaatgatctgtatcatcggagtaggacttctgctcagtgtcagaaccggatttatccagatcagaaaatttccatacgctatgaaggtgacgattgggcgcatgcttcggaaaaaagatgccacagatggtgcaatgacaccatttcaggcggtctgtaccgcgcttgcggcgacggttggaaccgggaatattgcaggagttgcaggagcgatcgcaatcggcggaccgggagcagtcttctggatgtggatctccgcacttcttggaatgtgtactaaattttcagaagtaacacttgccgtacatttccgtgaaaagaatgcagaaggggatctggtcggtgggccaatgtattatattaagaatggtctgaataaaaactggcactggcttgcatatttgtttgctgcattcggtgattattccggggctctctgagccacctgtccggactttgagagccacctgtccggagaatgagagccatatattccggtaattcagagccaccttattgggctctattacatatatttcctttatactgtaaagacacacccttggtgtgaatacagataaaggaggtcgtaagttatgaccaagtatcgtgaaatcctacgcttgaaaagcttaggattcagtgagaggaacatcgcacagagttgcggtgtatccagaaacacagtcgccaaggttttgaaaaaagcagcggaaatcaatctttcatggccgctggattttgacatgaccgacagtgcactagaggagctgatgtttcctaaagataagtcggcaacgaataaacgtatgccaaactttaactacatccgcaaagaacttctgcggaacggcgtaaacaaaaagcttctctgggtagaatactgtgaggagtgccgcatgaacagcgaagagcctctaatgtattctcagttctgctactacatccagaaggatgaagaaaaacgcagggctaccatgcatatccctagaaaaccaggtgaacagattgaagttgactgggcaggtgaccctgctcacatcattgatccggacaccggagaaataacagatgcatggatatttgtaggtgtattaacttacagtcagtatgcttttgtaaaagcatatatgaatgagaaaactgacaactggatcaaagctcatatccagatgtttgatttctttggcggtgtcacacctatgctcgtttctgataactgcacaaccgcagtgaatcataaaaagagtgactggtacaacactgccttaaacacaacttatcatgagatggcagaacattacaatcttgccatccttccggccagagtccggaaacccaaagataaaccgaatgtagagggatcggtaggaaagatatccacatggataacagcagcccttcgcaatgaacagtttttctctcttgcagaattgaatgcttcaatccgtgaaaaactggatgcctacaacgcccgtaaattccagaaaaaggaatgtagcagactcagtttatttcttggggaagaaatgccattactggctccgttgcctgctacaccttttgaactggctgagtggaaacaagccaccgtccagtttaactatcacatcgcagtagacagaatgttctactccgtgccttatcagtatatcaaaaataaagttgatgtgcgtataacagatacaacggttgaaatattttataatcacaatcgtattgcctctcacagacgactctatggaagaagcagtcagtattctacagtgacagaacatatgccgcaggaacaccagaaatatctggaatggaacggtgaccggttccgtaagtgggctgattcgattggaattaacacaagtaaggttgtcgatgcaatacttacctccggcaggattgaacagcaatcctacagaagctgcatgggattactgaaactggcagaaaaatattcgccagaaaagctggaacaggtctgcgctaaggcgctctcttattccggtaaacccagctataaaagtatcaaaaatctattggttgcaacaaaggatgcacctgataccaaatcagaatcatctcaagtagaaaaaccacacggcataaccagaggagccaaatactatggaggtaaacaatcatgacaaatcaaagtacaatcgataaacttattgaaatgcgtctgactgctatggcagatgcattccgcatccagatggatgatcctgcaatgaaggaagttccattcgaagatcgcttcggtatgcttgttgatgtcgagtatagcaaccgtaaaaacaatcgtctgaaaaggctgatccgccaggctgagtttgaacagccagatgccagcatcgcagcgatcgattaccattctggacgaaagctgaacaaagcactaatcaaccgtctggcaacctgtgaatacattacagaataccggaacatctttattactggagcaaccggaagtggtaaaacttatatggcctgtgcctttggcatggaagcatgcaagcactattactcagtacggtatgtacggcttcctgatctattattggacttacaggctgccagggacaatggaactttctcgaatgtcctgaagaaatataccaagccaatagtactgatccttgatgagtggctgcttcttaaactgaccgaagctgaagccagaaatctttttgaactgatacataaaagacgtaaaaaatcttcaacaatcttttgttctcagttccgtgaaagtgaatggtaccagcaaatctgtgatggtgaaagtactcttgccgatgctatcatggatcgtatttcgtatgattcctataaaatcgatattgaaagtgttgacccagctaaagacctctctatgagagaagtatatggactggatccagcaatggcaaagtaacttaataaacaaactgaggtggctccgttagtccggacaggtggctctcgccacaccggactggcggctctgccgcaccgtaatattcagtgcgcccgtaaaggcatcataataaatatacctttggcaaggtattaggatagtatcttacagtcctatcatcaaccgatttacctgtgagggaaactaaatatcagggaaaatagcacgtcggtaaagccataagtcagctaattaccaagctgcgactgaatggggagatgaaaagttaggtatgaggataaagcccatactggttgaacgatagtccaaacggtcaatgtcgggactatggcgtaaggtaattattattcgccatatctcagcacttatgttccgctgttcaggagcgtaagcaaagataggctgagacgtatatgcaataagcataaaaggatggaagtcgtatccgacaacctaacaagccaaatcgttagtatgatgctaaacggggattacctaagtcgaaacgcttaaaaataagctattaagtgtaggcttatgaatattcgatatggtaacggagccttcatagtagtccgagagtgttaatggcacttacatggcgaaggaaggcagtttataacattaacaatatagaaaggataatgtgtgatacattatgagaaatcctgaaaatgtgttaatcagcttaacgaagcacagtaaccaaaaagattacaagtacgagcgtttataccgtttgctctacaatgaggaactgtacttaaccgcttatcaaaacatttattccaatgacggaagtatgacaaaaggtactgacaagcaaacggttgacggtatgagtatcgaaagaatacggaaaatcatagtttcgctcaaagatgaaagctatcagccaaaacctgcaagaagaacctatattccaaagaagaacggaaaaatgcgtccactcggaataccgtcctttgaggataaattgcttcaagaggttatcagaatgattttagaagctatctatgaggggcattttgaaaatacttctcatgggttcagacctaatagaagctgtcatacggcactcaatgaaattcaaaaaactttcacgggtgtgaaatggtttatcgaaggagacattaaaggtttttttgataacatcaaccatgctacgttgattggaattttacgagaacgtatcaatgacgagagatttcttcgactggtaagaaaatttctgaatgcaggctatattgagaattggacttttcataacacctattcgggaacaccgcagggtggcattatcagtcctattcttgcaaacatttatttggataaatttgataagtatgtaaatgagtatgtccgaaaatttaaaaaaggtaaaaagcgtatgcgtacaaaagagtaccgcaggaacgaagtcgaattaagcaaagccagaatcgcattgaaaaatgcaaacgacgactgtgaaagagaaaatgcgattgcacgcataaggcagttggaaaaagaacgggtgaatattcccccaagtgaccctatggataacaattatgcaaggctggtctatgtcagatatgctgatgattggctgtgcggagttatcggttcgaaagaggattgtaagaaaataaaagaagattttaagaattttctcaaagaacaattacagttggagctatcagaagagaaaacgctgattaccaatgcccaaaaaagtgcgaaatttctcagttatgaaatcagagtacggcatagcaatctaaccaagagagataaaacaggcaagctcgttcgtaattacacgggcagaattgtactggaagtttcaagtgatacaatcaggaaacacttgattgatacaggtgctatgaagttaatctaccataatggaaaagaaatttggaaacccaaggcaatatacagattgaaaaactgtgatgatctggaaatactcgactactacaacagtatgatacgaggtttttacaattattactgtatagccaataacagctcaatcatcaacagctacaagtatattatggaatacagtatgtacaaaacctacggcacaaaatacagaacatcaatttcaaaagtaatcggaaaattcagagcaggaaaagattttgctgtaaagttccgtaattccaaaggagttgagaaaatgcgagtgttttataacgagggttttaaacggcagaaaaaagcattccaatctaatgcagacttagttccaaatacaatcaaatatttcagcagtacaaagctaatcgacagaataaaagccagagaatgtgagctatgcggaaaaactaatactcccatagaaattcatcatgttcatcggcttaaagatttacaaggtaaaactttttgggaagctcttatgatagcgagaaatcgcaaaacaatagctttgtgtagagaatgtcattcaaagattccagacgttctttatcacagaaacagtagtatgcatctccctgttcaattaactgcttagcatacttcatgtaaattcctgaagcctgtctttcactctgaacgtatggtccgacaccgccatctttatctgggccttcatcatgaacaaggcctgtcttctccagtgttctgtaaataatatccaatgcaccttctacatatctttcctgatctgtatcttcaatacggagcataaaatctccgccttcatgttttgcgatcaggtatgcatataatgcagtacgcaaattaccgacatgcattctacctgtcggactcggtgcaaatcttgttctgacttttttcattttagtgttcctctctttaacttctgttttattttcactgtgaaaataaactattcacagttctctatgacattcaaatatatgttcatctttataatactaacacattcccttttttacttcaagcattccgaagccactatttttcccgtttttctgtattttgcggttcctcagctccaggaacgatctttcggacgtacttcatggaattctgcttccactcactcttctgaaaagcctggaaaaaggtatccacgacaaaaattgcaagagagatcacgcctgcgatctccaatgtctggatcagataaaattcggacatcgcctcgttcccgtcgatcagataatgaaccgtctggtacatcccgtttccgggaacagtcggaagaaccccggcaatcagaaacaacgtaaccggtgtcttataaactctcgcaaaaatatgcgaaacaaccgcagctgcaactgctgaatataaagatgccatcacatctcctctgccaaaatgtattgcaagcagataaacaaatccaccaattgctcctacaataccagcctgaagaacaaagcggcgcggaacctgaaggagaaccgcaaaactgtaaatagataaaaacgctccaaatacccggatgatcatttcaaaaacagtactgttcattttttactctccttcctgctaaaaaatctttgtgcaaagcgccagcccaataccaattccaattgcaatcccaagtgcttttaagaaagcttccatcactcttgcaccaccggaaagataatccccccgcaaggtatccctgacagcattggtgattgccattcccggtacaagaggcatgaaacttcctatcataacagtatccatattcatctgatcacccagaccttcttttagaaggtagcaggcaaatgcaacaccaaatcctgcgaaaatatcctgaataaatgggtgaaatttcagatcctgtcccgctgatacaaaggcaacaagaaaaagtcctacaacgatggctgccccggtatctgcaatggatccaccaaaaaaaattgtaaatcccacaccaacccccatcattgccaggttggttgtcttgcggctgaactcgaactgttttaacatcgaaagcttctcatatgcctgctctagtgtcagatcatctccacaatactgcctggaaatctcattaacatctacgacgagctttagattggtatcccgttcttctactctctttgtaacagtaactgccttttcgttctccagtttgatcgtcgcggaaattccggtcatgatcaccagaacttctgccatctcgatgtgatccgccgtcttcagtatatgatgcatggtatcctccacacgatacgtttccgctccgcttcgcagcattatttcaccggcaagcatcgccgttttcagtaataattgcgtatccatgactttctccctctcactttttcggatttataactgtcatgatactatttcctattctaaaaatcaaccaaaaattttttcgtacacaaacagtacaatcattaccgttcacagtatctgtgacaaataatgtataatctttctgcaaaaacagtttttcgcaaggaaaaaggcttcccggtcttatgaccggaaagcccatcttcctgaattagagtgagagtgtttataaaaaggcagattttattagttaatatatccgctctttttcagttcttcctcagcttttgcgaggtttgcgtctgatacacggatgattggtcctgtgcatcccattccgctttctgcgtaaatgccgagtttccacagtactttaactgcgtcttccagatccattacttcaatacctggaatctgtgctgtaacgatttccttcggtggctcttttacttcttcttcagccgctgccggtttctgagaagctttgtgctcatcaaggatttcttttaatccagctttcttaacattcctccttattaaaacagataccttgcccatccaagcagatgctgtaccaaaaatatttttctctgacgtttctttgttaattcgattggctctacatgatatggatcattataagttccgccttctaatatctggcgggacactttttcatattccatcataccctcttccaactgtttattaatgtctttactgcgtattacaagcatcagttccgtatccagatatgcacttctcatgtccatattaaaggaaccgattacagacagatcatcgtcaatcagaatactttttccgtggtatgaataaccgccttcatattcccagatattaattcctgtacttaagattctatttctgtttttcgcataatcggcagacccaaatggattcccattattcgcaactgaatttgtcatgatagaaaaatctgaaaccttctctgcaatctcctcccatgtattatacatcatatcattacagataatatatggcgtgtggatcttcacacgattttttgcatttttcatcaattctcccaactgataccacactactggttctttggaacctgtgtgaataggatttgacactaatgtaatcttttctgtctcaaaagtttcgtccgtataatcggtctcgcagattctttccttattctcttcaaaatatttctgatagctgttctgcagctctaaaactgcgttctttacagattttctatttgccagttttttattgttatgaaaataaccactgtcttcctgattccatatggtttcaaaatactctgacaactggttaactgaattttctttctcaggttcatcgcaaaccactaacacgtctctgtcatagttcttatgtcccggaaaatcacccaggaaataattgtatgtatttcttcccccaagaatatatctctttccatctgcaatcaaatatttatcatgcattctacccatcattttccacggtttcaacggattggccttattatacagtttaatttcaacattctcatgggaagataatccatagaaatacggatttccctccatatcaatccagctctccattccatctactaacagacgaatatgtacacctctgtctgccgcatcatgcagtgctcctaaaatcaattttccactttcatcggattgaaatgcaaaagtagaaagaataatttccttttttgcattcttgatcaaacgcactctttgtaaaagcgcttctggattcttttctatgattactgcccgttctgtattttcactgcattcgttccatgacccattttttgtttcttttttggttgtattggacacttccggctgctttttatatgcagcgcagattccgagcaattcataaaaagccacacataaaaaaatcgccagtataacaagaaggattttacatattttatgctttttcattgtacatcacctgattcctttttatttcatacttatacaatacaaagtcaatctcaatttaacctcaacaaggtttgttttttcatccatgcaaaatcttctttgtacaacagactgttagatatagcaaaaacggccttttaaaaacagttaacttctaaatcaactgttttttgaaaggtcgtttcatcagattcttatagcaatccagcaaataatctcataaataattgtcccagtcgcaaatatgcacttcgtccgatttgatattggtctgtcacatcacgacattctcccatcgttcttatcagatcattttttatttccacaactgcctgacaatctgccataaaacagccgttttcaaaatggtgatataaacttcttctcctacttgctcattatccatagggctgtctgcataaggttgaacaaacccagtttgctgtgccgcataatcatagtggaaaaggtatttactaaaatcagaatcattagcatccttatcgcttactgcattccacatttccaaaaatgtcaccgtaagccaaagacatttaactgttcacccaatcaaacgtctttggcttatttaattacaactatttttttagagttttacccagtaactcatacagagcttctgcctcttcttgagataaagtaattccttttcccattttttcatgttctgatgcccagtcacaaatatcatatttttctgcagctccattccatgaaatcatatttaattcttttttccaacctttggcactttctgaaagtattcctattgggtaacaaaaaacaccgtatttctacggtgcgttctgtcagatatattctgttttatgatagcagaaaactggatcttctccgacaatgtgtggatccagaatacgtgaagtagattccagtggatctacagccgggtaaataccaagctctgtgatcgcacgggaaagtacggtcgttgcatccagatgggcaaatgttgttgccggagctgggtcagtaaggtcatcggctggcacatatactgcctgcacggatgtgatggatccgttcttcgtggatgtgatacgctcctgcagcgcacccatttctgtctgcagtgtcggctgataacctaccgctgaaggcatacgtccaagaagcgctgatacttcggaacctgcctgtgtaaaacggaaaatgttatcaatgaaaagaagtacatcctttccacctttatcacggaaatattctgcaagagtcagtcctgtaagtccgactctcatacgtgctccaggtggttcattcatctgaccgaataccatcgctgtctttttgataactccggattctgtcatctcatagtaaaggtcatttccttcacgggtacgttctcctacaccagtgaatacagaatagccgccatgctccgttgcaatattggtaatcagttcctggataagaacggtctttcctacaccggctccaccaaacagaccgatttttccacctttctgatatgggcacagaaggtcaacaaccttgatacctgtctccagcatctctgtctgtgttgcctgttcttcaaagcttggagcttttctgtgaatcggtgcgtattcaacatccttcggtgcctctttttcatcaatcggctcacccagtacgttgaagatacgtccgagtgttgcttcgccaaccggaactgaaatcggtcccccggttgctacggcgtccatgcctcgcaccagtccgtctgtcggtcccatggcgatacatcttacgatatcatcacccagatgctgtgcaacttctaccacaagttttcctccgtccttgcgcgtaatctcaaccgcatcgttgatctccggcaagtatccttccgaaaacttaaggtcaagaacggcaccgataacctgggtaatcttccctatatttttatctgccattttctcctccttacatacagaaacctgtatttatccgatcgcctctgctccggcaatgatctcggtaagttcctgtgtgatcgcaccctgacgtgctctgttatatttcaattccaaatcatctatcatctcttccgcattgctggttgccgaatccatcgcctgcatacgtgcaccgttttcactggcaactgcttccacaaatgcgccatacagaatgctgctgatatatttcggaacaagaaggctgattgcctcttccgcttccggttcaaagttcatcggtgtaagctgcgcctttgcatcctcttctcccgcttcttcctgcacctctgccggaaggactttgatcatcgtcggaatgtgacttaccgtatttttgaaaaatgtgtagatcagatagatctcaccaatctcaccattttcaaaatctgtcagaagtctttttgtaatactcttcgcatcatcataggacggttcttcgatcatctctgaataatcagcgacaatatcatatcctttgtgtttcagaagttccagtccttttcctccaattgcatagatccggatattctccttcgtaaaggcttcgttttcagtcaccatcttcactacattggagttatatccacctgccagtccacgattggatgttacaacaatgactgctttcttcttcgaatcatctgctttcaaatatggatgattgatattccctgcctttgcaagcagagaggtcattgttgcatacatacagtcaaaatacggctttgattcttctgcccgggttcttgctttctgcagctttacggtagagacaagtttcatggcttttgtaatctgctgcgtgctctgtacactggtacggcgacgcttgatatctctcatagatgccactttgtatcacctaccttgcctgaaattgttctttatattctccgattgcttttctgagagcttcttctacttcttctttcagcactttgtcattcttgatagattctggaatttccggatattttgtcttaatataatcaaaaagtccgctttcaaaagccagaatatcttctaccgcaatatcaagaagaagcttcttaactgctgcataaatgataataatctggtattctaccggcatcggctggtactgtggctgtttcaggatctctttgatccggactccctgtgccagacgttcggaagtctctgcatccagttccgatgaatggaaaaagaccaaatcgccagcctgtgcctgtgacaatgggatatgctgggttgcgtcatactgtgcctgtgcggttcgtggcaggctgattccggcttttccgtagcaccactgggtaagaccagaacagtcaaaagaggtgttcgggttactgccaccatagacatatttccagccttgatacttcaacgcttcattcataaccgcctgtaccgtttcgttactgaactgcttcacggtcagatattggttgaccagctccacataaaacatattcccgtagttataacgccagccaccatttttactgactgctatcgggttcgtataggtcacttttgtaccgccggatttattctttgcgaaattctctgcaagattgaagctgtgctttttcccgttcttcgccacatagtctgcatagccaccaccatagttgtaagattgaatgaccacgttaatgtcattcatacctttggctttacaggaagaaagcagagacgcaaaatatttacacccctgcttaatggattcttctgtacttaatgagtttggcggtagtcccagactttcactggactgcatgacatcgatagccgtaccgccactttccacctgtatgatggcaagcaggacgttcacatactccgtgataccgttttctctggcgtatttttctaccatcggctgatgtttgaggacatcggctgacaggttcatgccagagtagacagttgaataactgttggaactgttgtcatcttcgccggaaatcagtatcccgaaaaagaggacgatggagaaaaggacaggaaatatcgtacctatgataaggatacgctttaatctcatttcttccgtcctttctctggttgcttcgtaacagttttacgattctgtttttgattgacctgtgttttctgtaccgtagatttcttatgattgccgatggattctgctacgtttggctggttcgctctggtaaccgatttgacctgttgttcctgtctgatattggttcggacggtttcttttccagccttgatttctgcattttttatcacaggagaagtagcaggacgtttcatatccggcttcgtaactgtatcagtctgtgcagattttggaatagttgtggcaacagggcgttcatggcttctggtagctccggctgtcgctgatccattcgcatgaactgtctgccttgcttcctgtgctttctgtaattcctgctttttctgtgagatattttccctgtgcaggttgtgtttctgtgtacgctgttcctgtcggttttcccgttcttccacaacgccacgcttaaagtccgatacattatcctttgctttctgtttggcagaatagatagcataaccagcctgtgtcggtaagtctttcacattttctttcagagaagaagcactgtcacggactttatttttcgtatccattacagcacctaccgcagaaccaacacggcttcccatggaaacctcattattcctttgtggtctggctggcgtatttttatgtgtagaacgagagtgattataagcagaaccagcgactgcaccagcaccagctccgaccatacttcctgtacccacagcccttgcaagtcggcgttccatacgtcttgccctgtgtcgcatgaacaccatcggtctacggaatatccggcgacctatctgctggctgtcattggcattaaggctgaacatactcattagttctccgagcttcatgtagattccggcaaaacagattatctgcaaaaacgccaccatgaagaacggataatctgtggaaatgttgtagaacatactggaaatcgaaaatgccacagtcacaatcagcgtgattccagctcttgtcataatggcattgaaaacacggacaactgcctgtttcgccatgttctcataggtcggtatcatggacagtaaaaaactgacaggtaaaaacatggcatatatgataaatagtatctgggaaaataacatcatgccggtaagcaggaagataaagattgtgataccgagattgaaaatgagcaggaagaacaccatgccaagacggttgacgacctgtggaatggtaaggttgtcattgtcgttatcctcaatctctgttttcacaatattttcccttgtttccccatcttcatcggacgggctggcagataccagagcttctacacggtcagtcccgatttcttcggtatcgctgttcccgaactgcaacaacagccacggtttttctacctgtatcgcttcatgttccgcacctctacataaagtatatttattaaatctttatgtagtaattcactatatagtgaggtactatacagtcagtcccttgttaataacacaaaagaggtatgtacatgaaaaagaaaatcatagcaacaatcacaatgctctgtttactgaccgttctctataattatcttagactgccggactatcatattactaacagcatatcctttagcagtgcagataccagagatactgaattgactgtaattgtttacaaatgttggaaaattgatggattaatcaaagacattgaaaatgaacataacaaaatcaatggtacgcctaccaccttggaaatcaagctctattatccaacttattacttgcacaataatagcaaaccattccgaactacaaccattgaatataataaaaaagaatagcactctattactgcttttgaagtagtatcggctattccctctccttatattcttttgttcgtattttcgcaaactaacgttccgcaaggatgcccagtgcgacggttcctaacagggcggcgggtcgactgggcaagtggtcggctgagaagcattttctactcaacgacatatttaacgtttgattctctccgtccctcatatttctcctgtgccaacagtttatcaagaaattctgacacttcttccatgtcttcactgtctatcaaatccagttttatcaatacatcaaggtctgtctgattcttcggttgtattgagatcggctgagatgtatccacaaccactttcaactgttttgtcttatttgctgtttcaatatccgtagttaatcccataacgtggcttttactcacgccgaatatctgtgataatttttcccatatagattcatctctcggtgttccgtttccattttcatagttcgtaagcatactttgtgaaatgcctaattcttttgcaagttccgcaacggttatattcttttctttccgcaattcttttattttattcatagcaaacctcctttataagcacattatatttcatcaaattttctctgtcaatctttttatcggatattcagatattttctattgacattctgcaatgcttgttttatcataagattatcttaatatctgataatcagatatctataaggaggtgaaacgatgattagaggaaatgactttattttaaatccagacaaactgcaagaggaatttcagttagtagaagtttctgactgggtagacttttctacaaaagaaaaattaggattctactatacagttcttcttccaaaattaaagtttgaaaaagtcaaagtaggcattaaagctaacacagcgattgttaccaacgaagaacttgaacaaaaagggcagattccagtctcatttgatggattacatacttgggctagtctctataatggacgtctttctgtcaaagcagaagcttccaatatcagaaaagtgggaatgaaataatttccctactatgtcagccagtcagtgccggacaacgtcataggtgctgaactggctgacctctatacttgatatataaaacaacatcttccgaaaacaatcggaacattcattacaaaaattgggatatgaggtgagattcgtgagcaatacaaaagagtgttttgcatacaatacgaaaatcattgaaactcctactacaaaagaagtatatatttacgaaaaccctatttttattcactcgaaagaaaaggcagatttaacagacacaagtaaccgaaaaaaatttgatgaaatgtcagctcataagcaatatgacagtttaaaacgcaagcagaagcattacgaacaggctcgttgggatattgcccgtattgttgactgcaactttgataacaaaacaaaatttgtaacgctgacatttaaagaaaacattcaggaaatcctgataactaaccgagaatttaagtattttatccagcgattaaattattatttgtaccataccaaaacccagttattaaaataccttgcaacgtgggagaaacagaagcgtggagcaatccattatcatgttattttctttgattttctgtatatagcaaaagaaaaattacagaatttatggtcacatggatttattaaaatcaatcgcattgatgtagacagcaaagaaaacagaggtcgttatcttagcaagtattttggaaaagaccttgatttgaaagaacataagaaaaaagccttttttaaatctcaaaatctgaaagttccgcaaaagtaacttctacctatatggaatttactcttgcatttggtccaaaaccggaatttagtttttcatttaagttataaaaaatagaatagtagtgatagaaaaaagtacaaataagaatcgaacatttgtacttttttcttgcgttaatctatatactttcaaaaatttatttgatataatagggactgttacaagaacaaacagtaaaaatatgacaggaccggaggttagtattttcaggtatttccgagtgctgttttatccgcaaatattagttttgtgacttttattcgtaacgaggtgagaaacacatctattcactataaaaatgagcttttcgttacgaatctggatacgaatttttggctgataatgatcatagtaaaagtcacaaatggagggatttaccatgaatgagttcaaattaaaagccccatataagccaaccggagaccagccacaggcgattgcagagcttgtgaaagggttcgaggaaggcaatcaatgccagactttactaggggttacgggttctggaaagacttttacgatggcaaatgtgattcagcaattacagaagccgacacttgtcatcgctcataataagacgttagtggctcagttatacggagagttcaaggagatgttccccgataacgcagtagaatattttgtctcctagcatgagaaagtcacaaaatgggtggtattttgtagtgtgtgggtggttgaacatccagatgttgtggaagtggaagtggtgaaagtataggtgaaaagcgggtggatgaagaggttttgtgacttttattagtctttaaaagaagaacatagataaacaacattgatattatgaatggaaggaaaatgaatgatatttagtatatgggataatgagattgagaagaaggaaaagcaaaaaaagtggactgataattttagaaagataggagaagaggtatatactttttttgtagatacagtaattgagaaaggatatgaaaatcgagagggacaatgggatatgtcttgtgaaataacagatgccatgaaaagaaagcaacatattttagttgaagctggagttggcataggaaagacatttgcatatattgttcctcttttgttttatcacaaaaaatatggaagaccaatagtaattgctacttcaactatagcgttacaggaacagttggaatcggatattaatgttgttgaaaacattattggctatcatccagaaataatattggtgaaaggtcagaaccattttttgtgtaggaatagagcggatcaatttttctttcataacaaaaacaaagaaaacaataaagaaatatatgaagaaattgaaaatggtggttgcgaaagaaatgattgggatataaatatttcagataaaatttggaatcaaattaatgttagagaatttaatcctgtattttgtagacaaaattgtgtgcataaggattattgctattattataaaatgagaggggagttgcgaacaacaaatggaataatactctgtaatcaggatttgcttactattaatctagtgaaaagacagaattggggtaatgaaattcttacagataaatttgaatttgttgttattgatgaggcacataatttagaaaacaaagtcagaagtgcttttactaaagagatgagttataattcactttcaaaaacgatggaacatataagaaaaatttctaacagaataggaagtatgattgacgaaaaaataaagaaatattatgaatatttagatcaagtttttagtgaactatataagcaaaaagaagaacaagatatgaaagcacgtaaaaatgatagagaaatagaaagatattatgtgaattgcaatattcctgctttatctaaattaaaaaaatgtgttcatgatatttcgctcgaagtttccatacaatttggagtagaagattcgtataaaactagagatgtcgataatggaatagaagaattacaagaacaagaatatttttgggaatcgatgttaaaaggagatagtgaagatatattttggatgaatgcaaaagggacaaaagaggttattttgtcaagctgtcctaaaaatgtaaatcaattgatagaacaactttatttttcagattctaatttcacaacaattttaacgtctgcttggtcctatgtcaagatttagtacaagttaaaatgaggttttccccattttaacctgccatcagcaattcgtgttgtaaagcagtcaaaaacggtcatgcaaaaggataatcatttttactaatttagaggataatcgagtttgctaaataacatagagtgtttgcatttattaaagtaagtatacacattatacattttttagtcaatgcaaaaatcctattcgtaacaaaaatattgattatcaatctgtttccacaccccagaaccctgaataaactctgcctggaataaaacattctctggaatttgtgatccattccagtaaacatattctgcattctttattgtacgctcatcaggttctccccaaataatttcatcgttaacgaaagcatattgtcctgactgcacgattacttcaaaaattgtatttggaaatttatcgctctttacacgattcataattacagaggctactgctatttgtgcttcgtcatttaaacctctacattcttggaataaaacgcatgagatccaccaaatgtttgttgaatctgtttcagaaattctttcttgtgcaacagctgtagaaatatcaggattgttttcctgttcttcttttacgagttcacctactgaaacaccttctcgtattttattttgggtgaaaatatcttttgtataattattcattattttaattgtgaaattggattcattttttgctgaagtttcagaaatataatctatgttcgtttggtcaaaatgaattcttaatgctccaaaaataattaaaattatgccaataaaaatgagaagtattccaataaattttattttattcttcataagaatcaccttatttaccagtagagcctattccacctgtacgttctgttgtaacttcttcttcgtcagcaatgccaaattttacgaatacagcctgtacaattttttcattttcatcaataaacattgtttcattgcttgtatttttaattgccaaaaaaatatgtccttcgttatcagcataagcataatcacgatcaattactgctgttgtgtttaaaagaaccccactgctgatatatccctgtgcttcagtcaggtcaatatatccttcgagcattttctgtgtgtgatcaaactgatctaagatatcatcgtattcatctttcaggttattaaacttctgctcgtaaagtttagattcctgttcgcgtaaatcagcgattgcatcacggcaatctaaggctttttcatcattgtattttcatccgttcgctacacggataagagtatatgaaatactcctcatactttcatatgagattggactatatcttctatttgaataatttgttttggatttttattttgattttgatattagaaaagagcagtagtgattactgctctgaatcctgttctttttctttaattggaatattaattatttctagtctttctacttccataggaattgcatcttccaaataaaccattttattactaggttttgaaattaaaattgtcattggaacaaatacctcaccagacttcataagtcctatattcattcctttacttcctatctctgagaaaacaatataatcagcttttgcatttttagtattttgcaccttccccgatggaagataaaatacattagcttcttttaaagcactatacatacacaaaaacatagttatacgttctttataaatcttatatctattttttattgaatcatttattgtaaaatcagaaagtgtcaaaccattctcaatagcactgaaaaatcgatcttttccgattttcccatttatatgctgaatggctaacatatggtaaattctccattctctaaattcaattcgcatagtagttccatttgtaaaatagtacacaaatatttgattaaataatatctcttctgaaaattctttatatagttcaagagaaatgtccttgatattaggcttttctttttgaatacataattcgtcttttgttaacatgaaatactccaatatagcaaaatagcgttcgcaatacacgaacgcttaaatgcttattttagacagcgtcctgaatatgatataatcaggaaattctatggtagttttacgtcccccaatagggaaaatgagctgtctcattcacctttactttagagtaatcaaggcatctctcctagtataataatgatgtagtcaatcaagactactaggttaataagtttctataaatcagataacagaagaagggatacaaaaagcaatgccgatggctggttaaggaagaaccccgcagagagcttttttctgcgggggaaaggaggaagagaccgggatgtattatgatatgtctgggtttgattatggaatactggatgtggtgcaggtgctgcatctcagaaagcggcggggaaactattatgactgcccgttttgtggagagacgcatggaaaactgaatatcaatgtggaaaagaatgtattccggtgcaaccgctgtgatgcgtccggggggatgctgaagctttatgcggatttgcacaatgttacactctccgaagcaaatcagcagatccgggaagcattaggaaaaggagaataccggacggattatatcaaagcaacgccggtacaggaagaaaaggcaacggcagagcttgcacccatagaggaaatccaccggacgtatcagagaatgctgtccatgctcacgcttaacaggaagcatcaggaggatctgcaaagacgaggattaaaaccggaacagatcgaagcacagcgttaccggagtgtcccgctgtttggaatgaagaagctggtcaaaaggctggcagaagaaggatatatggtgaaaggcgtgccgggattctaccgggatacagacggaaactggacgattaacttcaaagcagaaaactcaggaatcctgattcccatagtttctttggacgggttcatccagggttttcagatccgggtagatcatgtgactgacacgaaaaaatatatctggctgtccagtgtcaattatgaccagggagtttcctccggaagtccggtacatgtgatcggtgatcttgccgcagaacgtgtctatctgaccgaaggagccttaaaagggaccatagcccattatctgtccggcgctacctttgtgtgcgttgccggagtgaaccagtaccggaatctgaaaccggtgctggagcggatgaaaggatatgggatgaaacagcttttggaggcgtatgacatggataagaagatgaaagtagcctgcaataagcatgacagtaagtgtgcggtctgttttgagcgttcccctgttatctgccagcataaggcggagaaacggaggattatccagaacggctgcaataaggtctatgaaatctgccgggagctttccctgccgatgaaccggatggtctgggatatggacgagagcggggagtggaacgggaaacacaaggggattgatgactatttagccgccatcaaacagaaggaaggaaccggggcacagacttcggctcttccgaaaggagaacaatcatgagaaaaaaaggaaatacggttcttgcaggactcattatctgcctgttgcttgtttttctcgcagcggcaggaaaactctttggtgcttatctgaagtatcagaaaggggacgtaagttacgagaaactgcaggaatatgttcaggaaccagaggaagaagaatcaccggagtctgagaaagaaaaggaggaacctaagaataggtatctagaaattgattttgcaggtttaaaagcggttaatccggatgtcatagcgtggattcagattccggcactggatattagttatccggtggtacaggggaaagataatgcatattatcttcatcaccttttttcgggagaatccaatatcaacgggagcatctttgtggactgccataatcagccggactttacggatcagaatacgatcgtgtacgggcataatatgaaaaacgggagcatgttcggaactctggataagtaccaagacaaagagctatttgaacaacatccggagttttatctctatttgccggacaagatcctcaagtatcgtatcttttcctgctatgcgggaagaaccggaagtgagggatataggtatcatttcccggaagcggaagattttcagacgtttctggatacggtgtcttcttatagggattatgataccggcaccgagctgtcggcaacggatcggatagttacgctgtctacctgtgtcaattccagacggaattatcgctatctggtacatggaaaattaagcagtgagatcatcacagaggaataaaagaatcgtgctggtgtgagaagaaatttcttatgccagcttttattatgggaggaaatgtaagatattccagaactgaccgaaaaatgccggaatgaggaatgtgtatcggtgttccgttcctttaagtcctatgcttccggagaactggttaagcatgaggaacaggacaaggctggtatgggttatacgctttatattggctcgctaaaaagtgaggtgtacttctgtgtctatgaaaaaagctatgaacagtacatcaaactggggattcccattgaggaagcaccgataaaaaacagatttgaaatacggttgaaaaatgaacgtgcttattatgctgtccgtgacctgctgacttactatgacgctgaacggacggcattttctattatcaaccgttatgtacgctttgtggataaggaagcagacaagaaacggagcgactggaaattatctgtccgctgggcgtggttcatcggggaaaacagagagccgttaaagctcacgaccaaacccgaaccctacacactggacagaaccctacgctggattcaacggcaggttgacccgacactcaaaatgctggaaacaatcacagcgaaaacagggattgattatctgaaagaaatccgtaaatccacgaaactgacggaaaagcactacaagataatcgaacaacagaccacatcaaccgaagatgtgattttagaaaaggagaattgaaaaatgcaacgattattatttgacttcctgttcttctctttagggggaacagttggcgtgattgccatgtgtattttacaggctggcagacagtctgacagaaaaatgatggaactgaaaggagaaaagaaagcatgaattttggacagaacctttataactggtttttaagcaacgcacagagccttgtgctgatggcgattgtagttatcggtatctacttgggattcaagcgtgagttttccaaacttatcggattcttggtagttgccttagtagccgttggtcttgtattcaatgcgtccggcgtaaaagacgtattgttacagttatttaataagattattggagcgtaaagcctatggaagaatgtagcgtattgattgaaacgactaaattagcagaggataaaacctctcgctggtttgatttacctattgattatgaactgttccgtgacctgctcggggtggaagctgacagtaaagattatcaaatcacagatatgaaacttccttttgctggcgacattgtaaggacaacatctgtcagacggttaaacaaactgtactttacttacacggatttatcgccagaagttcagcaggcatacaaagagttgattccctattgtggcggtgtagaggatttattgcagaaatccgaagaatttctgttttatccagagtgccacaacatcatggacgttgcccgttaccgcttggagcataacattgaattttctgctctctccgaaaagggaaagaaatattttaatctggaagcctacgcccatgaactggaagaaaaaggacgttatgccctctgcaacaatggtatgttcaaactttaacaggtggtattgcttatggcagaaatgaaagtatttgttatcaatcttgatgaacaggaaaaagatacaggctgtgcatggtttacacttccctgcaacatagaagcattaaaacaatccattggcttaccgccggacagtgaccgttatcttatcagtgattatgattttccttttgaaatcctgcaagatacagaccttgacctgttaaacaatatctgccttgcgatttcggagtgtgaaattccacccgaagatatacctgcaattcaaagagaatggttttcaaacctgcaagagctggaagccggactttgcaatattacataccatcggaactggtcaggtatagaagaaacatcggaacatttcttgtgtgtgcatggcagattttatgaatacaatgagtgaaaggaagtgaacctcttatgattgatgatatgcaagtctatatagccaatcttggcaagtacaatgagggagaactggtcggggactggttcagagaatttcttgaaaaagaaaatcgaatctatgagctcgcagcagaagtaaagggacttcttgtaggcagtgtgacgattgcagcatattccagtatttctacgcactggcttccggaggtgatccgggactttgaacaggattatccgcagatcgaaatccggcttatggagggaatccggcaggaagtgacaagatggctggatgaaaaaaaggcggatatcggatttttaagttatcaggagccaatgccgtatgagtggacaccactggactatgatgaaatgctggcagttttgccaaaagatcatccgtatgcatcaaaagaaagttatccgttaatcaattgtgagaccgattcgtttattatgccggcacttggacgggatgatgatgtggtttcgctgtttgagcgaaatggaatcaaactgaatattcattttacaactctggaaaattttgcgacaatggcaatgattgaaaagggacttggaatgagtgtgatgaacaatctgatcacggaaaagtggaattgtgatgtagtgaagattccggtagatccaccatcaaggatcacacttggacttgcagttccgtcgtataaacaggcatcaccagcggtaaaaagatttatcaaatatgcggttgagagactgaaaaagatagaatagaggagaacagaaaatggcagatttatttcatcgcgtaagtatcagaaaatatcaggacagaccagtggagagggaaaagattgtggaaatccttcgcgcggcaatggcagcaccgtctgcaaagaaccagcagccgtgggaattctatgtaattaccaaaaaagatacactggagaaattatcaaaggcaagtccgtatgcagggatgacggcgaatgcaccggtggcaatcatatctgcatatcggaaagattgtgatgtcccatgttatgcggacatcgatatgagtattgcaatggagaacttatggcttaagacagatgaaatcggacttggcggagtctggcttggaattgctccgatcgaagagcggatgaaggaagtggaagagatcgttgggattccggaagatcagagagcattcgcaatctttccacttggatatccggcggaagaaagagcgcagcaggaccggtttgatgagagcaggattcattttgatgcgtagaagttctgtgaaaatgtttaggtaaagcataagaaaacaggacagatatttgatatcatttttatcagaaaatgaggaaagtgatatcaaatatctgtcctgtttttgtgtatacgatgtgcaaaatgcagatttatgtttgcataaggatttgtatttggaaaaagtacatcacctggctgttaagcaagatggtacacaagctgagcaggagcagcctgctcgattattacgacacagccggcgtcagaaactctttaatataataaagtgccgcaccaatcgcaggagtatactgtccatgatttcccaccagaagctggctttcgtccatctggaaaagggaactttcattgatcttgcttaaaagatactgcatatctgcttcctgaaaatatggtgcaagatatccgctgatgatcaccggactgtcgatcacaagattcaggttacggattgcaaaggcaaggtggtcaagatagtctctccagatttgtgtgagattcagagcatgtgtctgatgcaggaggttaaaaaattctttgaccggcataccggaagctgctttcagggcatttgcagaacagtaagtttccagacacccgtgattgccgcaataacatttcggaccatttggatcaatgcagatgtgttcaatcagaccactacgcatatgatcgccctggtgaacttcatgtccggtgatgatcgcaccgccaaggttaggattcagaagaaaaatcagggcactgtcaatgtctgatcgcagtagaacaggattacacaggaaaagcctgggacagagcacttgcttacggtcttgcaatcggtggagcaagagcaggacttcttgaaacaacatatagagtagagacagaaacagacctcttcggagaacaggctgtactttgcggtggtgtatgtgcccttatgcagacaggtttcgaaacactttgcgaagcaggatacgatccaagaaacgcatacttcgaatgcatccatgaaatgaaacttatcgtagacctgatctaccagagcggattcgccggaatgagatactcaatctccaacacagcagaatacggtgattacatcacaggaccaaagatcatcacagaagatacaaagaaagcaatgaagaagatcctctcagacatccaggacggaacattcgcaaaagaattccttctcgacatgtcaccggcaggacgtcaggtacacttcaaagcaatgagaaagaaagccgcagaacatccatcagaagtagtaggagaagaaatcagaaaactctacagctggaatggtgaagataaactgatcaataactaagcgataggcaacaagccggtcagctaaacggaaatagaaggagtcccggaaaaacatgctcgcatgcttttccgggactccttctatttctgattagttagttggcgccgccaacggtcgaacaagctctgcttgtgagactctgaccggcttgtatgtaaatcattcgacccacaaactcacaaacacatccagcggaatcgcgctatgcgccaattccgcgtcccctcaaaacaaaagtcccgtccttccacaaacacatcccagtcaaaccgcgctatgcgccagtttggcgtccccccaaaacaaaagtcccgtccttccacaaacacaccccagccaaaccacgctcctgcgccaattccgcgtcccctctaaacacccatcccgtctcattccatcccgttcctccaccatactccccttcaatatacatattgcacaacctatccctctgtgctatactaaaaccagtcaaaaccaccaaaacaacttaaaggaggaactagaaatggatgaaagactggaagaccttcgctccgctaaaaacccaaaggcgcgaattaaaattttaaaaggacactttgcaacaagtcattcccacatcaacacctacatcgacatgtcaacggtcaaatcccgtcacaacaatgcccgtgaaactgcaaaagttcttgcagcagcttacctttctaacacaacggtagataccatcgtttgcatggaagagacagaagtgatcggaaccttccttgccgagcagcttgccgatgagaaccagtactcactcagcaaaggaaacaacatttccattattaccccggagatgtatcaggacggacagatcctgttccgtgacaacaaacagagaatggttgagaacaaacaggttctgatccttgcagcgtccatcacaaccggtaaatctgtcaaacaagcaattgagtctgttctttactacggtggaagagtctgcggaatcagtgcaattttcagttcagtcaacaagattgcaggaatggaagtcaatacgatcttcacaagcagtgatcttccgcattacagagcatattctccggaagattgcccgaagtgcagagaaggacagcggatcgaagctatcgtgaacagctacggttattctaaattataagagaaaatcagaagacaaaaaaagtctgtaccgaatacaagcagcatttcagtacagactcttttttgaaagatttatgaaaacaaaaaagggttataggacaaaacgtgttgatggctaatcccagccatcaaacgttctatccacattatgtaagtcgctccaaattgatactttgagtaaatattattctatacacgaattttcaaaaattataggtgtatctgctcagacattacgaaattgggatgcaaatggaaaacttcatccgcatcatactacagtaagtggctatagatattattctgatgagcaactcaaccaggtaataaatgtaaagcctaaaaatcgcattacaattggatattgtcgcgtttccagccataaacaaaaagatgatttggaacgacagattgataatgttaagacatatcttttggcaaaaggacagccgtttgagataataagcgatatcggttctgggattaattataagaaaaaaggacttcaggaattgattagacgaatctctcaaaatcaagttgaaaaggttgttgttttatataaagacaggctattgcgatttggttttgagttgatagaatatatcgctttactttataattgtgagattgagattattgataatactgaaaaatctgaacagcaggaacttgttgaagatctggttcaaataatcacagtattcagctgcaaattacaaggaaaacaagcgaacatagctaagaaacttatccgggaattgatacaggaggaaacagatggtaaaagccataaaagtaatgctgataccaaacaacgtacagaaaactaagatgtttcagtacgcaggtgcttcaagatttgcttataactgggctttggccagggaaaaagaaaattatgaaaaaggtggtaaattcatttcagattcagaactcagaaaagaatttacaaagctcagacattctgatgaatacgcatggctgctgaatatttcaaataatgtaaccaaacaggcaatcaaagatgccggtactgcgtataagaactttttcaagggtttgcaaaaattcccaagattcaagtctaaaaagagatcaatgccgaagttctatcaggacaatgttaagatacaattcagtaatacccacgttaagtttgaaggcttttcttccagcaggaaagcaaataagcagaaaatgaattgggtaagacttgcagaacatggacgtattccaacagatgttaaatatatgaatccgagaatatcttttgacggattgaactggtggatcagtgtatgtgtggaatttcctgattgcaaggaaacacttaatgatgatggagttggcatagacttaggaatcaaagatttggctgtctgctctgatgctgttaaatataagaacattaataagagtcagaaagtaaagaaactagaaaaacagaaacgcagattacagcgtagtatctctcgttcttacgagaagaataagaaaggggaaagttactgcaaaaccaataatgtaatcaaaaaggaaaaacttttattaaaacgaaatcacagattaacaaacatccgtaaaaactatttgaatcaggccatatctgagatcgtaaatcgaaaaccaagatttatctgtattgaagatttgaatgtcagcggaatgatgaaaaatagacatttatccaaagcagttcaggaacaaggatttttttggtttagaaaacaacttgaatacaaatgcagtgctaaagggatccagcttattgtggctgatcgtttttatccatcatcaaagctttgcagctgttgtggaaatatcaaaaaagatttgaaattatctgacagggaatatagatgtgagtgtgggaatataattgacagagatttccaggcatcaataaatcttaaggattatggagaacgatttgcaagctgacactgaaacgttaatgcaaatatgtacggatacgttagtccggaatttacgcctatggagagtacaagaacttgtgagtagatagataggggctgtaaaataagtccctaatataagaaacgccaattccggaaaatgtcggttttggcgtttctttgtattaacttttctatttctaagcaagtctgcatctttgggtataaaaaatggtgcatttaataaagctcggctaatcacgcccgcttaagttttatgcaactttcgtctgtcgttgctttttgttgtgatatttataaagattgaatccacatgaaatcagtgtaagctcgagaattacatttttctcgcctcttcgcaataatcttttatacgctttatcccactttaatacaccaaaagttccctccgattgaatacttcggttcattctcaagagagcaccatgtatggattcaagattttgcagcacttcctgatggatagcagttaattcctgattcattcggatcgttcggtttttgtgtactctcggacaacattcttgtttatgctgacacccttcacaagattcacattcgtataattcttccgttcttccatatttattatatttcacatgctgtgttctcttgaagaggaattttcgaccgtttgggcataagagatttccatctgcatcttttgcaaagtttacagcacgatacggattctcatgatactttttgtccgtcgtttcttttttgtacatggtaaatttcatgtatttttccatgccgtgttcttcacaataaagataattattgtaagaaccgtatccggcatcagcaactggatatttcggatagtgaccatatgtgcgattgaatttttccatcaaaggcacaaagcattccatatcggatgcatatggttttacgtcgattacagctatgtattcatcacagatggctgcctgtaggttgtatgccggaagtagctgatcgtttcccatgtaatcacgctttaaacgcatgaaagttgcatcatgatctgttttggaataactgtttctttcttctccacaggtctcgatatgatatgcataggatttcaaacgttctagatattcatgcaattcttcgtattgtttttgttgaatgctttttctatgaccacgtccggaaacgaaagaagtttcatccagtccagttgtttctttgtacatcgtaagtaattcagagacatagtcaaccgcgtacgcttcacgcttttcaaattttattccgagatatccaagtacttccagattcatagcatcaatcaagagtgaaatcttgtcaaagactttctgccggtttttcacacacgattttttccatacccaggtatatcgattggcatttgcctcaatttttgtcccgtcaatgtatgtatgctgcagatccacgtgatctttggcaaaaatatatgagttaatgtcttcaaatatctgcttgatagaatcggttagttcgtttcggattaagtttccaaatgtagcaaaagaaggtgttttcatgccatcaagaagatacatgtaacgaatgtcattacggcagagcttttctatttctcgtaaggagcagatgccgttttccataaaggcaaaaagtattactttaatgagtttttgagcatcacatcttgggcgacctgttttatagcctttctctacaaaatatctggataggtcaatgtgatccataacctcacaaaaagtgtataccggatcggaaatatcgatcaatttttcgatttctaatggtaatttcagctgacgcatagtataattaccattggtattgttatttagtagcataattaattataccaaaaaatcgctcagacctcacggtctgggcgatttttctgtcaggggagtttttttacagcccctccatatcttccacgcggtcctcccggacctcttcccatatttctcgttgcctgatcaaacgcatttccaaaagaacgcatgccctgttccgcgccatttaccgcaccgttcactgcccggttgatcgtatctgtgatcgtctggttcagcttccggtaatcctgcgagtctacagcatcctgcacggttcgtctgatctcttctccaaatctttcccaatcctgcattttcagcttctcctttattttgaaaacttgatcctgtcgtcaattccgtgcgaaagaacataatcaaaaacggtttttggcaccagatcatcccacttttcatctgccaggatcctctgccggatctgggaacctgatacccctttttcctctttggtccttctccagagaacttccaccggaattccaagcttctcaaaacgcttctcattgttcgcagtccattcatcacagatactcataaagcagaccgcaccctccggcagatactgccccagatattccactctgtcaatcggaaatgggatgatctcaaactcttctctcggcactccgaaactgagcaacgtatcacgaagcatctcataacgctcaatataagtcagaggattagcgctccgtcttacccggtaattgtcttcctcaccccctgatacgtgcagatcatccgacatagtgattcctatataaagccttttgcagcgcatctttgccgccagaatatattccacatgtttgagatgcagaatctgaaatcttccatataccagccctttttctatcatttatacgtcccttgctttctgtaattttatcttttcaatgatgttgaggtcaaaaggtattttaacccttttgataccagattgctacgtgctttgcactctcgcaatccttttcaattggtctatctgtattctactacagaacggtcgttcttagcaagaaatacctctgtatacggggctgtgaaaaaagaatagtccaccaaaaaagaaagaccaagagtttataatgaactcaaggtctttctttctgttataattaacttgcaatgaaaattaataacataatctattctaacccaaaacaggcagttttgccaatgctaattcaagattatttggacgtctgtgatccagtgctgacttttgatagatttatgggagaaatcgaactggagaaatatctgaaaaatattcctcaacatgatacaggaagactcaggtatgacccggtcagcatgctgaaaacagttttgtttggatttatggcgaatggctatatatcattgcgtgaactggaggatcagtgtaaaatcaatctccgcttcatgtatcttatggatcatcaagcaccttcttaccgtactttcggctacttcatcaacgaagtacttgctgattccattgaagaaatatttcaagacataaacaaaaaaatcttcgagacagaacatgtggatcttcaacatctatacattgatggatccaagtttgaagcaaatgcgaataaatactcctgggtatggaaaaaagcaaccgaaaaatccagataccgtctctttggtaagatcactacactctttgaggaaatcaatgaggaactttcatgtataggtatgaaactttgtatcaatagtgagtacgcaccagagtatctgaaggaagttgctgaacagtatgcagaagtctggcagattaatgaagcaatgtttgttcatggcaggggacatcgcaaaactacacaacaacgtcattatgagaaactcaaagagtatgctgctaagttggaagaatacgtggaaaaaatcaacgttggtcttgtattcaatgcgtccggcgtaaaagacgtattgttacagttatttaataagattattggagcgtaaaattaagaatcccacattttgaacacaaacttgtggtaatatactaatatcattaaaatgtttaaaggagattcttattatggttagatacagtattgaaatcggacagcaagaacaagatattttaaaagaaatcgttttagccagtgataaaaatgtaaagaaacgtaaatttgcaacagggttatcgtctatgatggctgtcataatgttaatatacacgattctttgctttatgaatagtcgtattggctatggtattattggattattattttcagttttctttatctggattatcataaacggagctaacacatttcagaaaaaagtaataaatattgttcattcaaagatggataataaactgacttcgggaaaacgtgaatattgttttgataccgatggagttgcagttagttctgatattggtaacgggactaatcattggaacgcctttaaatgttgggggattttcagaaattacatatatatcagaacaataaaaaatgaaatggttcttgttaatcaaaatgatttgtctgaaaatgatgtaaaagagttaaaatcccttttgagtcagaatttaaaagaagaaacgctttaatattgttttagagttaagcagtctttcagttatgatcgactgcttttttcatactcaaaattagaagaaaggactgaattacgatggaagaatgtagcgtattgattgaaacgaccaaatcagcagaggataaaacctctcgctggtttgatttacccattgattatgagctgttccgtgacctgctcggcgtggaagctgacagcaaagactatcaaatcacagatatgaagctcccctttgctggcgatattgtaaggacaacttctgtcagacgcttaaacaagctatactttgcttacacggatttatcgccagaagttcagcaggcatacaaagacttgatttcttattttggcggtgttgaggatttgttgcaggaatccgaagaatttttgttttatccagagtgtcacaacatcatggacgttgcccgttaccgcttggagcataacattgaattttctgctctttccgaaaaaggaaagaaatattttaatctggaagcctacgcccatgaactggaagaaaaaggacgttatgctctctgcaacaacggtatgttcaaactttgacagatggtattgcttatggcagaaatgaaagtatttgttatcaatcttgatgaacaggaaaaagatacaggctgtgcgtggtttacacttccctgcaacatagaagcattaaaacaatccattggtttaccgccggacagtgaccgttatcttatcagtgattatgattttccttttgaaatcctgcaagatacagacctcgacttgctaaataatgtctgccttgcaatttcagagagtgaaatcccacacgaagatatacctgcaattcaaagagaatggttttcaaacctgcaagagctgaaagccggactttgcaatattacataccatcggaactgttcagatatggaagaaacatcagaacatttcctgtgtgtgcatggcagattttatgaatacaatgagtgaaaggaagtgaccgtttatgattgatgatatgcaagtctatatagccaatcttggcaagtacaatgagggagaactggtcggggactggttccctcgtataatatcttttagatacataaatacatgtatctagttaccaaataaatattgttcaataggcttagcaaagcccatgatataattgtcctagtgtcaatcaggtaatagttcttttcctccctgttgaaccagtaatggttgcttcataaacagtccgttcccctgacatggaagttagcttcaaaccggctggctgtttgcttaagtacatggactaccatctagcagtgtggtttcgcatctgtccatcttaagctggattcttatatgcgagggtgtcgatgctccatgatcatgggttttaccaagccgattgaacactttaatctacaacgaaagaaggtgattacaatgaacacactttacgtcggtattgatgtaagcagcaaatccaatgtcgtttacttaatgcttccaaatggtgataagcacagtaatttttctgttgcaaactcacacgaaggttccacccaattggtaaaaagaattctttctgctttaacttcacattcccttgacacggttctgatcggtcttgaagcaacctctatttatggatacaatctcgtgtacttcttaagagaagatgccactctggcaccgtttaacagaaagattcatgtcctcaatcctaagcaggtcaaaaagtttcatgacgcttataatgaccttccaaagaatgattatgtggactcttttgttattgctgactgcctgcgtttcggtagaatcaacaaagaggtatatatgggagactatcgttacaaagctctccagaacctcacacgggcacgtttcttcgctgttcaaaatctggtaaaagaaaagcagcgatttatgaatgtgctgttcaagaagtattctacgatgacgcaggagaaggtcttcagcgataccttcagcactaccgcccttgctgtctacgatgaatttgaatccgcagaagcactggcaaatatggacttacatgagcttactgactttatcattgaaaaaggaaagaatcgttttcctgatcctgatgcagtagccaaagccatacagaaagctgcccgcagttcttaccgtttaccaaaaacggtaaatgattctgtcaatcaggtgctttccatatccataacctccatgaaggcattggaatctcaaataaaagaattcgataaagctattaaagcccaaatggaactcttgccaaacgtattgatatccattccgggtatcggacctgtttattcagccggaatcatggctgaaattggcgatatcaatcgttttaacagtcaggctgctcttgctaaatatgcaggacttgcctggaagcaacaccagtccggtggcttcgagtccgaagttacacggctcattccatccggcaaccgatttttaaagtactatctgtgtgaagctgcattttctcttgtaagatgcgacaaggaatacagcgacttctaccacctcaaatataaagaggtaaacagatgccaacacaaacgtgcactcgcattaactgcccgtaaatttgtgcgtttagtctttcgactgctgaaagacaatcgcctatactgtccagcaaagtagattccatctacttgctgattagctacgccctgctcatttttaaaaatttgaacgacagggcttaggtggatgttttttgtcttcatgagatatatacaaaaatatatgctttttgtgttatttatctcttgacatcacaccgctggactgttttgaagtgattaatgaggttgccatgcctcgcaaacccgcataaatactgaatgtgtggagttttgctcatggctactacaaattaactatggaggttattatggcaaattacacaaaaacaactattggaaaggaaaaccgaattgagctgcatgaaaagttgtctttaacaggtgcagaaatcagtttaaacgaactacctgcaggagcaaatgtcccatttgttcattctcataaagaaaatgaagaaatctatggaattctttcaggtagcggcaaagccataattgatggagaagaaattagcctttcaactggagactggctaaaaatcgcacctactgcaaagcgtcagttttttgcatccgatatttctggaattacttatatctgcattcaggtaaaagaaaattctctggaacattttacagcagaggatgccgtaatcggctaattaaaagtatttatttacaaaaatgcacagttcacgataagctaagaactgtgcatttctttttgttcaatattacgttttctcaatttttcaaacaagaagttatcagtgattatcttttagaaaacagccaactacagcgacgccaaatccaagaacacctaggacatatccccaaaaattatttgttgtcacagcaattcctaaaggtattattgcaatcccaaataactcaatcttaattcctttcatcgcaaataccttcgttacaaacttgaagttgtcaatttctttattatctaatctgttagtaatctatccaacagcatctgcctgttgtttataaacatttctgttacctggtagctctctgtatcctcatattcgcacagatgtatgcgtccattatcaaaacaatagatatctgcatctggtattcctaacaaaatcggcgaatgcgtaactataataaactgtgctccctcttttgcacaactatatatttgcatcaacaatgtaagctgtctctgtggggataatgcagcttccggctcatcaaaaagatacaagccatttggatgcagattgttctgtgccaatgcgagaaaactctctccatgtgatttttcatgatatttggcagaaggatgtgcgagatctgcatattcttcttccttcgttgcaacattataaaaactttcagccctaagaaaatacccccacttttccttccgataacctttggaaattcttatcgcatcacacagctctgaatgtgtatcatgcgtagaaaaaacataattctctttaaataactatcgttatcaattctattccaatcgaatattaccccttgtaagaattgatcattcatctaatcaccttcctgtaaaagacactttctaatccaccaatccttcgttctaaagatgtaggacggattttgcggacattcaaaataaaaaagaatgtggaggtaacagacaatggcaaagacaatttttgaggaaatgggcggcaaatacgaaaggcaaggcgattacttaataccttgtttgactgtacccgccgaagaagaacagccgataggcatctggggacagcggaatttggattatctgaagcatcactgtaaagttacatacaggtgtaaaaatccagaaacgtgaccttgaaacaaaggataccaaagcacagggaagtgcgaccttacagtacacagagttcaacatcatttccttaaatgataatcctgtactggttgaggggaaattatataacaagaatgaaaccgtaaagaaaattcagacaggcattgacggaattgcttctacttctgctgatttactcccttacggaaattacagattagaagaaagcaaagcaccagagggttacttaacagacggtgctaaagcaatcgacttttctatcacggaagatggaaaaattgtggacttgaccgacaaatcccactctgtctacaaccagattaaacgtggcgatattgagggtgtaaaaatcggtgcaggtacacacaaacgtcttgcaggtgttccattcagaattacaagcaagacaacgggagaatcccatattgtagtcactgacaaaaacggtcagttctccactgcttcaagctgggcttcccataaggtcaatactaatgccggaaaatccagtgaggacggtgtatggtttggaacttctgaaccagacgacagcaaaggtgcattactttatgatacttatgtgattgaggaattaaagtgtgattccaacgccggatttaaactgattccagcttttgaggtggtcgtatccagaaataaagtgaccgtagatttggggacactgactgatgaatacgaaaaagaaatcacaatccataccacagctaccgacaagaaaacaggcgaaaaaatgattgttgctggaaaagacatcaagatcgtggacaaagtcacacttgatggcttggaaacaggaaaaaaatataaactttccggctggcagatgttaaagaaagaaaacgccgaacttctgattgacgggaaacgtgtagacagtgattatacattcactgctgacagcgaaaaaatgacggttgagattacctttacctttgatggttcttctcttggcggtcagaaccttgttacctttgaggaattgtacgatatgagcaatccgaaagagcctgttaaagttgccgaacataaggacatcaacgatgatggacagactgttcttatcacggaacgtatcatcaaaatccatacgaccgctacggacaagaacggcaagaaagaaatcgaagccggaaaagacgtaacgattgtggataaagtcacattagatggtctggaagttggaacaaaatacaaactttccggctggcagatgttaaaagaggaaaatgctgagcttttgattgatggaaagaaagtatccaatgattatgagtttacagccgacaatgaaaaaatgacggttgagattgcatttacctttgatggttcttctcttggtggaaagagccttgtcacatttgaggaattatacgatatgaccaatccagacgaaccaaagaaagtgatggaacataaggacattacagacgatggacagactgtgacaatcaaggaagtgccggaaatcccagacacaccaaaggataccgacacgccggatacaccatctacggttactaagacaagtgacagcccaaaaacaggtaatctccagctgcttgcttacgcccatactggtcttaggctttatttcctgggctttttagtcgccggtatcaatattgtgctggttgcctatttttccgcaatcgaccgggcatgtcctgccgtccttggttctgttatgcgcggcattatcgcaattgctttctgtgcgattctgttctcacagattctggggctgaatggaatctggctttccttcttaggatcagaaatcatcacattttttgtgattctgattttccggaaatcttgattttgtaattgacaatttttcttttatcatgtatattttaattatagtaatgattcttattattgagttttaaaagtcaggaggaatgtcatatggataaaaaagcactttacaatttatcttatggagtatttatgcttgcaacacgctctgggaatgtagtaaacggatgtattaccaacacctgcatccaggttgcgaataatccggtacggatcgcaatctctgtgctgaatagcaactatacctgtgatctgatcaaagagagcggcatttttacgttaagcctgcttgaccagacctgctcttttgaaacgatccggcatttcggtttccagtccggcagagatgttgataaattcgcaaatatcactgcacctgcagatgaaaatgcagttccttacctcggatggcagacatgttctgttctcagcgcaaaagtagtttccagacaggatcttggaacacataccctttttattgctgaagtaaccgatgcgaaacttttaagtgacaatccgcctctgacttacgcagattatcagacacatgtaaagccaaaaccagaacagaaaaaagaggataagaagattatcggatggcgctgtaagatctgcaattatgtatacgaaggaagcaatcttccggaagaattcacctgcccgctctgtggacacggcgcagatgatttcgaaccgatttatgaaaatgcatagcctgttggaaaatagacgtttcaaaaagagggagtgtatgacttgagtttaagtcacgcactccctcttccaaatttccagttttccgatattccttttctaaaataccatcagtttataaatattttccacatctttctgatcaagagttgcaaatccttccactgtaccagtatttacatctccataacagcaggtatgtgccagcttttcaatatcttcttctttggctccaagctctgcaaaattctttggcatcccaatcgaaattaaaaagtttcgaagtgcctcaattccttccagtgccgttctctttggatctgcaaaatccatctgacagccccagacacggactgcagcctgtgcaaaacgcatcacattgtgttccagtgtataagtaaatacagccggcataacaaccgcaagccctgcaccgtgcgcgcagtcatacaatgcagataattcgtgctcgatgttatggcttgtccagtcctgtgtacgtcctactccgcaggaattattgtgtgccatcatacctgcccacataatgtttgctcttgcctgataattatccgggtccttttacagtgataagatactctttttttctaccttcactatctccgaaaagctcaatccatcccttttccagcattgaatttaatgcaccatataaagtgcctgctcccaatgaaagccgcccacctgttttttcttcaatgaactgcatgacagcatatccgtgtttaggtgaatagagtgaaagcaaaatatagaatgtcacttctgtgagtgcaccacttttcacattatccctcatagcattccctccttattacggttactgtaataactatatcagtaaccgtaataaaaatcaagagatgtgaaataaatcttaataagccggatagtattatgcttttcctgttcagtcctttacaaacaatacttatatataaagtatttctctcaacaccatttcttctgcactagcttttatattattcatcagtctaacccacttcgtccgattctgtacctttaattcttcagttacgccctgtttttttgccatctgttccataagcatttccacctgctctctgctctcttgatcaatctgattcaggtgttccgtcagctttccagtcaacaacaaatattgatattttgctaatctgtgttccttcagaaactgtttcctcaacattccatatttcccatatatcggttcttcttcattcaataccaaatccggcaaataataatctccatgcaaagtatagcttaatccgttcttttcatcataaatgtgtgtttccataatcttatctctccatttctctgttttttgatttagttttcttacgctgctgattctccatctcgctttttttcattccccatgccaatctttcatgaatatttcccttcggcatttgttccatccgtcgcttttcttccagaactttctcgttttgaatatcctgctgtactgctgtatctacagtttctattccaagaacacgcacaacacgatcatacctatcagaaacaccttgtaatatatctttttcttctgacaatttctgattatctttacgtatatcatccagttctctctgaatagcattatatttttgtttcaccttttgatattttctcttccaaccttccacctctttcgtgagttctttaacctgagccgccattacagcaaccttattctttatttgaagaaacagtggtttaatttttttatctcgataggttactgcccgttctagcgtgcccacctccggcagtaacattttaaccgttccatattctttgatttctttgctcacactatccataatcggttgtagctgttctctgcgatcttccaggctttttagttctttttctgcgctccctgccttttgttctgcttcttgcttcgccttgattgcctgttccttatcgtcttttaaattctggatatctgctctggattctgcaatttgtgctgttaattcttctttttcagcagttagatgctctttctcctgctccaattcctgtacttcctttttccgttcttttttctgacattcggaaacttggagtttgccggagaaaatactacggaacaacagagaatcaacgggcgtatggctgtcattaccagaagctacaacctgtattccgatgtgcagagagccgatgatgtagttgtgacacttcctgccaaagctggcgaaaagcatttctcgccagagcagaaagtaaaacttatcaacccacgaatcactactgatggctataaaatcggagaacgtggatttgtcaattacatcttacttgcagacgatatgttaccagcagaaagtaaataagggggtattcagattatgagattagcaaatggaatcgtcattgataaagaaaagacttttggagtgttgaagttctccgcattacgccgtgaggttcatgtgcagaatgaagatggaacggtcagtgaagaaatcaaggaacgtacctacgatttgaagtgcaacacacagggacgcatgatacaggtatccgttccggcgactgtgccgttaaaggactatgattacaatgccgaagtggaacttatcaatcctgttgcagacacggtagcaaatgcaaattatcgtggtgcagatgtggactggtatgtaaaggcagatgatattattttgaaaaataaagctactcatgccggaaatccacagaacaatgttccacagcaaccgccgaagaaatagattcataatttagattctcattgtattgctcagaggtaattgatataatgcattatataatcatgtcagatttttaggtgttgaatctaaaatggtatgatataacaaaaatcaaaaaaatgaggataacaatatgcattcaaaagaaaagatagaaaatgtaaaactcgatcttcaaaatgtagatacagtgatagatgtaaaacataatccagtaatttcagcatttgtttcatcaataaaaacagttccgtttttcggtgatttaatagatgattctttagaatatactttgacagattttcaaaataaaaagcaacaacaacttttagaagttattaataatgcatctgttgggtcagttacatcagacatggtaaataatgtagaatttattatgagttttgcaaaaacacagaatgctgtcaataaggcgttgaatggagataaggtaaaattctatggaaatttgctaataaacgggtatttgaatggaaatgataaaatatcaacagacgaatttgaagaatatatagaattaataaacacactttcctatagagaattagaatatttgtcattttttaaagagttctcgaatgaatacaaaggacgattagtatatcaaaattggagaaaattttgtgcggaatttaggaaaaaatttccaaacagagatgttgattccgtatttaagcgtctacaacgaactgggtttttaagtgaagtgatagaaactgctgatgttgagtccagctaataaatgtcaataattaaatgagaaaaaaatattttgttttctgactaaaaaagggcagactttccccatccttaatttcaaatgcagtcctgtccagaacctcctgtccacagcggcttatcccaatcaatccacttttcccggaaccctttgcctggaaaataaatttggaaacagcttttccgaattgtcttgtcagataatcctgaagcgcaattcttctgtgttcttctttataatattcttctggaaatctcgcctggattttcttcacctgaatactcagctttgacggagaagcaaatggatctccttgtacatgatcaatattgagctggtatccctgaaactgatagcttcctctcaaatctttgtaagctggatagcttcttcgattgatactcatcaaatttttttctaattctgctgctgatttcatatcctgctccctcttatcaaattctatgatgttggggtcaagaggtcaaaaatcctcttgcaggcaagtttgcatcggctttctgaccttttgaccctggtatcattctattttactagcaaaaatttacttggtgcatattaaattttttatagaacgaaaaaagatgtaaacccaatttatacaggatttacatcttctaaatcatgaagcatcggggattcgaaccccggacaacttgattaaaagtcaagtgctctaccacctgagctaatgctccatctgttatacagcttgccttctttcgaagacagtgcccagaaccggaatcgaaccagtgacacgaggattttcagtcctctgctctaccgactgagctatctgggcatacacactaatgtgtgagttgcgggagcaggatttgaacctacgaccttcgggttatgagcccgacgagctaccagactgctccatcccgcgatgatatctcattatagcacattttttctaaatatgcaatgggcggaggtggattcgaaccaccgaagcaaattgcagcagatttacagtctgtcccctttggccactcgggaatccacccatatgaagttttactgtcttccaacagacatcattcagattaactgtctgatgcaagccgatgatcggactcgaaccgataacctgctgattacaaatcagctgctctgccaattgagccacatcggcatatcaatgggaccaatagggctcgaacctatgaccctctgcttgtaaggcagatgctctcccagctgagctatgatcccatgataatttaattaagcaatcaacactaagtgtttcttgcaagcgacccgaatgggactcgaacccacgacctccgccgtgacagggcggcgctctaaccaactgagccatcgggccttatttaaaggcatttcatgtaccttcaaaaccacatacaaatttaaatccttactccatccattctttcttaccctgtcctaccttcttggttatgccctcgaccgattagtaacagtcagctccatgcattactgcacttccacctttgataggaacaatacttatattcagagcgagggaatcaatcaggattttggtgtttatgattgtccagatgaactgttgaaggaacatcatcaagatatttcagcctttaaagcatttgcttatagacatattggaagacacctcatgaatcgtaatgtcaggaagattagagaacgatagtattaagcttttagaattaaaattaaatttggagggtaatatggcaggcaaaatacaaaatgcttatgaaacatcaaaaaatatatatgacgatgttcttacgcaaaagaatattttcagcaaactgtatattaagttattttggagttgaactgctgtatttacggaaaacaaatggagttctctgaaaaatgcacatttgaggaaaaggatgaggtgttgcatggaattgacctgacgatgccggcaggaagttttactgcattggtcggaccgagcgggggaggtaaatctacggtagcaaggttaatttcaagattctgggatgtgacgtcaggcagcattactataggtgatgtgaatattaaagaaattccattgtcacagctttcagaaatgatcagttttgtgacacaggataatttcctgttccggtgttctatcatggaaaatctacgatctgcaatctgattgcccggttctatgatgcagacagaggaagtgtccgcgtgggaggacatgatgtgaaagaatttacctgtgacagtctgttatccaacatttccatggtatttcagaatgtatatctgtttcatgatacagtgaggaataatatttgctttggaaaaccagatgcaacagaagcggaaatggtagaagcggcaaagaaagcatgctgccatgattttattatggcattaccggaaggatacgatactgtcatcggagaaggcggagggagcctgtctggtggagaaaaacagcgcatttccatcgcaagagcgattctaaaagatgcaccgattattatcctggatgaagcaacagcaagtgtagacctggaaaatgaacatctgatccaggcagctatatcggaacttacaaaaggaaaaaccatagtaaccattgcacatagactggcgacgattgaacaggctgaccagattctggtggtggatgatggacagattgttcagagggaaacccacagagagcttgtggctattcctggaaaatacaaggattttgtagatatcagaagccagtcagaaggctggaaaatcggctaaaaaggaaggaaaaacatggaagaataaagaaaactatcgggaaaaatcacaatggcaacagcaggttgcttttcagactgcggatttattgatatgataaatagagatgagcaaaacacattaattcaaaagtaggacgtggcagttagtttccataaagtttgaagttacgattttaaccgcctccgtgtaagaggataattacatcgctgttttcttttccatattctacataattcaacctctttcacctcactgtaaacttccgattttctcaattctccaaacttgaatttgtaattacattccatacatattggcattctttacaagtactttatcacccttttctaattgttccttggaaattcctcgtaacccaagtccaacatgctctgttttatatccacaaccatttgcttttcgttcttttgtatgtacatcgacagtagtaattctggtttctaagatatctccatttgctttataaatacatgcattttccccttctctgcacatccctgttaatatgtttcctgtggcaactgttccaactcccataattgtaaatatatcatcaataatcaattcaaaatcttcttttaaacacgatggaacatctaatctgctcatgtattctgtttctcgttcttttttgcttttaccaaataatcccatggtattcctcctttaaaacttccgatttgtatatttcttaattcatactataccataacaaaatgcagaatagtatagataaaacaacaaattaccatactattctgctgtaatatttatcctacaatcttccagttatcgtccttatgaagcacaagctcatactgtgagatttgcgtcattttcgacttgttatccagatactttacggacacactgaccttgatgttatcgccatctttggtaaagacagggtttaccagttccgaaaatacatagtcgccggatacaggagcaagcacaccgtctttgacatagtaggcaagttctttttctgtggctgtcgggtacagcttaaagaatgtttccaagaaagcagtagcgtccttgactgtgtcggagctgacactgacatctgtttcctgtgctttcggttcatactttgatttctgcactgccggagcaagggtaggattctgggtaatgaccattgcaccgtccttatccacatgaacggtcacggtatagttttctatgactgcctgtgtctgttcgccctcttttacctgctgatctacttcgtaggcaacggtaaaatcgtccgttccagactgttctacattccagaccagcacatttgtaacagtagcactggttggtatgtccgttctaatagtatcggcgttcaagtcctgtaattctttggtaatgtatttactgatttctgttgtccttgcttcaatggcttccttgctggtatcccatgagtagtaggctttcgcaaagttcttgacgaaattttcaataccgttggtatcgttcaatcttaactgaatgatttctttttcatgtaccgtgtgggtgtcaatggcggtaaagttcttatacacaccaaagctggtgcttggcactgtcatagctgtcattaatcgaaataaatcgaatctgtagaagtgggaaaatatattcaatataaaatccaacttccagatagtctcttccaaatctggagaagtcttttacaactacacagccgatttctccgcttttcatgtcatcctgcagctgttgaaatccctgccgtttaaaatgagtaccgctgacaccgtcatccacatattccaggatatctgactcagctacacccagctgatcaatcacaaatgattttaacagaattctctgagaagttacactgtcgctctcttttttggctctgccatctacattgtcatcttctgcggataaacggatgtaaacagctgtttttctatgatctgtcatcttgtctgcgcctccttctctttctttaatttctgtaaatctgcaaactgatcgtcatataccagcttgatctcataatcatacttaccatggataataattgaatccacaaaggcatctgccatttcttttgtcagcttacgctttgacatataagtatgtatcacatttccccagccttcttcaatgtggtaatcctgggaataccgaacctgtgccgccaatactgtgtccagacggctcttgatattctcaatttcattggaatagatccgagaaaactgtatgtactcttcttctgtaatcaaacgttccgagtaatcttcatataaatccgatttacgcttactgatacggctcagttcccgtcgaagtttccccacttctttatccaaaagcaggtactgtgtctgatttttggaagctgtattcatttcctgaatcattttttccgtatccaatacggttttcatatgcgtttggatcaggcgaagaacatcgtcatccacatattcttttctgactctgtgccctttgcattgctttcctccggatttatggttagtattggctccgcagatataaaagaatgtgccatttctttctctggacaacgtcatgcggttgccacagcctccgcaccatatttttcctgtatagaaattatggtttctaatagccccattgttctgctgatgtttcttcttataagcttccgtatattcctggattttagattgtacctgttgaaacaactctctatctataatcccttcatgcgtgttctccacatgcacccattcactctctggtcgatttctctgtttatttccctggaaaacactttgctgatattttccaaatacagaatcacctgtgcaatgaacatcctgaagaactcgtttcacttcataattgttccagggttttgactccggaagcggcttctcaccggttttatagaattttctctgtaaagtcggcgataaaactccatctttattgagctgtcttgcaatatcactatactgtaatttcgctgcctttcggtagggggcagttttatgccggtgatatgccgtgcgaagccccgcctcgcccacaagttcagagcggtgggctgccttgatccccacattttcatcctctgcctcataaatctttttatgagcgtaaccaatggcagtattggcgcccgccttgaccggacgcaggggtacaggtccttttacatgggccttttgggatttaacctccttttcaaattttaagtgttttttggcttttccggtctccgggtcggaaaccgtctccatgcgcagtttcttccgggccggcagacgattttgcgcctgctctgctttttgtgcagtccgttccgccttccgtcttgcatgggtgagctttttatcctttgtctccggtggcagttcatccgcagtaaattccagcttggatgttttcggcggttcgctatccacacccttttccttttgtgctgcctgttcctccgcctgtgccgcttcctgaaaacgctgctgatatttgttcccatgctgatgtgtccgataacgatgtccctgaccggatctgtctgtgccgctcggtggggctgatccttcggaagaaggtgcatattgtccggtatcatggtctgtcacatcctctgttacaaaagaacgcctggaaacctcctgccggaaattgcttcgtccgttgtcctgtgtcggggactctgttccggtagcatccggtatctcaaagcgatccgaaaaaacatccaaagcggccgcataagcatcgccctgttccagcaaggacaccggtgtttccggtgatagctgggaaaattccgtctgtacagggatgtcctgcctgtgtgtcttgccgttgacagaagaaggggtgtcccgtgccctgcgcaggtcaaaatcctgttcggtctgcctggctgccggttgatcttccccgtgggaatcacgcaccggcatccgggtatctttgcgctttctttgaaactccctgtcgtgtgccattgttctcacctccgatccattttaatttttgtctcacgctttggtccccgctatttcatccggtcttgtggtaagcacactgtacaacagtgtgtccttcgggaagtggtccacaaaggggatgatcacatttccaaagaacaaaagcccctcgccgggaccggaatgggtcacataggaaagctggtgcggggagattcccagctgctttgccaaaatctgactttgaagtgattaatgaggttgccatgcctcgcaaacccgcataaatactgaatgtgtggagttttgctcatggctactggtttaagtaaaggaggtttgggatatgagttcaattattttagaagcaaagtctttaaccaaagaatataaacaaacattagcattagaccacataaatttacaaataaaaaaaggaaaaatttatggatttattggtcaaaacggagcaggtaagactacttttttaagattagtcacagggcttgcgtttccaacaagtggtacactttctttatggggaaattctggaacagaagaattgcagaaacagcgtaaacgaattggaagtatgattgaaacgcctgccctattcccgtcaatgactgcctatcaaaatatggaagtacagcgtattcaacgcggcataccagataaatcagttattaaaaggacattagatatggttggattgcaagatacaggtaaaaagagtgtccgcaatttttcattaggtatgcgtcaacgattggggatagcgattgcacttttaaatacaccagaactattgattttagacgaacctatcaatggtcttgaccctgctggaattgtagaaattagaaatttattaaaaattttgaataaagaatatggtatgaccattttggtttcaagccatatcttagaagaattgtatcaaacagcatcagaatttattctgattgaccatggaaaaattatagaagagatttctgattatgaattaaatgaacggtgtaaacgacatatagcaattaaaacaacagatgttcagaaaacggttctggttttggaagagaatcttcatacagataactttaaactaatgccagatggcataattcgtttgtatgattatttgaatgatttagagacagttgcgtctgctttggcagaatcgcacattcttgtaacaggactttctgtatctggcgatactttggaggactattttttgagcaaaataggaggaacaaaagatgtcaaatctcctaaaaactgagttatataagttgtttcacagttggtatttttggggaattggaatattcaatctccttttaagtagcatatttggtgctagaatataaatagtacaagtcaaaatgagaattccttattactgattttatgatactatgtatgtatcgtgcaggatattctggatatgctgtttcagcatcaccagtacggcatcttccagatccttttccggtattctatgactggaacagcgttttgtttctttatttgtggaacatagataataagcatattttttccctgccacagtggaaacctttcttgtcataggtgcaccacaatccgcacatacagcaattccggataacagatatacctgcttttggtcaggtgaagtacgtgtatccatgcccagaagtctctgaacaatttcaaaatcacggtcactcaccagtggctcatgatttttctcaatccggatccagtcatcttccggtttcacataagtctgcttcactttatggttcggtgttgtcctttttccctgcacaaggtttccgatataaacctcgttttccagtattctgcggactgtaacagaactccaaagtgcctgttctttctgtcggaagccagtttcataatgactgccactgctgattttatactcaaatggggaaagaatacccagttcatttaaacgattagcgatcgcatcctgactcattccctgcagcttcatcttaaaaatatcctgtactacactgcctgcagatggatcaatctctaatttatgcttatctgtctttgtcttcctgtatccaaaagctacaaacggagtcacgcattcgccttttttcctcttaatctcaagattactcctgatcttaatagaaatgtcacggcaataagcatcattgattaaattcttaaatgggataatgatttcgtctgcctgattctttcccttgagactgtcataattgtcattgatggcaatgaagcgcacaccaagagccgggaataatctctcgatatacttcccggaatcaatatattcccttccaaatcgtgataagtcttttaccactatgcagtctacaatcccacgccggatatcttccagcattgcctggaatgctgggcgctcaaaattagagcctgagtatccatcatcaactcggactgaaacaacttcaatatcttttttgtctttcaggaaatccagaatcaaagctttctggttagaaatgctattactttccagttttgctgaactggaaatatcgccatcttctttagataatctgacatagatggcggcatgatagatgcagaaagtaacaactttttagtttgtatgcgacaaacgtttgaacactttttgaacaccgcaaccgtgatgaagtctccaaagcccctttctatcagtatttttgattacttaaaacggttcgattccggtctgcggcagtgtttgaaaagcaggagaaacgttgaatttacagcatttctcctgctttttgtttaaccgggattctgttaaatacgcaatttgccggcgtagaggcagaaaagtagatacagaaaggaatggaggcataaaaatgggagcatatcaactgaaaaatgaagaacttacactgactgttatttcagcaggcgcagaaatgaaatcgctaaaagacaataagacagagcaggaatatctgtggcaggcagatccaaagttctggggaagaacatcaccggttcttttcccgatcgtaggaaattatgtgcagaagcagtcggtatacgaaggaaagacatatacgctgtcgcagcatggttttgcaagagacatggaatttgatctggagagccagacagaagaagagatttggtttgtactgaaagatacagaaagtactttggaaaaatatccatttcattttattctgaaagtaggatacagactctccggacgtcaggtggaagtaatgtggaaagtagaaaatccaaatgataagaagatgtatttttcgatcggagggcatccggcatttaactgtcctttgaaagaaggagaaaagcaggaggattgtcagttggtatttgatacagaaggaccgctcacgagcagcatcctgaatgaagaaggtgcactttgtccacggacaaaaatcttaaatcttttcggaaaatgtctgaagcttgaggaacatttatttgatgaggatgcacttattattgaaaatcatcaggcacagaggatcggtcttgcggatgcagatggaaaggtttatctggaagtagaatttgatgcaccgctttttggaatctggtctccggcaaaaaaacacgcacctttcgtatgcattgagccatggtatggaagaagtgacagagaagattttgaccatattctggaaaacagtccagcggtgtgatgtcaagagataaataacacaaaaagcatatatttttgtatatatctcatgaagacaaaacctgttgccacacctgttccaaaaacagcacagaccgatacggtcataaagccggatatgaagcgtcctgctacttcccctgtgataaaaaatgcagaaatcaaggctggaaaagaaactgtccgaaccaacatcagacaggaacagcaggtcaaatcggttgccagaacgaaccagccaaacgtagcggaaactatcagtaatcataagaaatctacggtacagaaaacacaggtcaatgggaaatctgcccgtaaaactgttacgaaacattcagagaaaggacggaaaaaatgagattaaagcgtatccttatcataggtacgatatttcctgtccttttctccatcgttctctttttcgggatattgatttccggcgaagatgacgacaattcaaacagctattcgcctgtttattctggcatgaacctgtcagccgatgtcctcaaacatcagccgatggtagaaaaatacgccagagaaaacggtatttcggagtatgtaaacgtcctgcttgccatcatacaggtggaaagtggcggtacggctaccgatgtcatgcagtccagtgaaagtctggggttaccgccgaactcattaagtacagaggaatctatcaagcaggggtgtaaatattttgcgtccctgctttcttcctgtaaagggaaaggtatgacagacattaacgtggtcattcagtcttataactatggcggtggctatgctgactatgtggcgaagaatgggaaaaagcacagtttcaatcttgcagagaatttcgcaagaaacaaatctggcggtacaaaagtgacctataccaatccgatagctgtcagtaaaaatgggggctggcgttataactacggaaatatgttttatgtggagctggtcaaccaatatctgaccgtgaagcagttcagcaacgaaacggtacaggcggttatgaatgaagcattgaaatatcaaggttggaaatatgtctatggtggcagtaatccgaacacctcttttgactgttctggtcttacccagtggtgctacggaaaagccggaatcagcctgccacgaactgcacaggcacagtatgacgcaacccagcatatcccattgtcacaggcacaggctggcgatttggtctttttccattctaataaacctgtaagcactcatgatttatgtttttatgcatactaaccgggcatctgaaaatagtgtgcgagactaaattccacatgccttatgtgcaagactaaattctggtgcagtgaaatctgcctgtgctttactattttattttataagttttggactaagcataacatcatcaggtgcgattgcctttaatcctaatgctttgtgcagtttgttgtccaagagtaaaagagagagttcatatgggctatgtccattaagactgtctcttttttcgttgtttatgtgattcatcataagtctgactttctcgtcatttaaatcagcgaatgaacttcctttcggacggatgtagcggatatactcgtggttcttttcacagacacctttttgccaaaagctgtatggatcacagtaaaagacagtcgtacttttacttccgtcacagaattcctccatctcttcacgagctgagaattctgaacctccatccgtgaggatcaccggaaaaagctttttgaatgcatcctgtcctaacactgtttcaagccatacaaagacctctaacacgcattcctggtcttgatattccaacaggaacataagcataagattgcagttgcggaatgtaaaggtcaagagggcgctgctttcgcctttcattccttccacgcagtccatttccacaacatttatatctggatgatctttcatataattctggaaattttcgtagttatgaccttgacgataagaacgatcttttgcactggtctgtgtaggtttcttgcgtttcttataacgtacagaacgccttaagtcaccattgcggacatcgaatacacaatcattgatgtaggagtaaagtgttcttctggagcaacccaattcttctgcatgagtagcataaatatgaccgatggactgatgcttctccttgatcaatggaaccaataaatcattcatggattgaatgctttccggagtctggttaatgccgactctgcaatcgactagcacgctacggtactcatcatgggcatatttggatgaataaaactttctgggcataagacaatgggtctttttaccacagccattacatacgtagggtggtttattcagtttctcacattcagccacagcctgtatctttttcctgttcatcaagattgataacaaatactttcatttctgccataagcaataccacctgttaaagtttgaacataccattgttgcagagagcataacgtcctttttcttccaactcatgggcgtaggcttccagattaaaatatttctttcccttttcggatagtgcagaaaattcaatgttatgctccaagcggtaacgggcaacgtccatgatgttgtggcattctggataaaacagaaattcttcggatttctgcaataaatcctctacaccgccacaataggaaatcaactctttataagcctgctgaacttctggcgataaatccgtgtaagcaaagtacagcttgtttaaccgtctgacagatgttgtccttacaatatcgccagcaaaggggagcttcatatctgtgatttgatagtctttgctgtcagcttccacaccgagcaggtcatggaacagctcataatcaatgggtaaatcaaaccagcgagaggttttatcctctgctgatttggtcgtttcaatcaatacgctacattcttccataggctttacgctccaataatcttattgaataactgtaacaatacgtcttttacgccggacgcattgaatacaagaccaacggctactaaggcaactaccaagaatccgataagtttggaaaactcacgcttgaatcccaagtagataccgataacaacaatcgccatcaacacaaggctctgtgcgttgcttaaaaaccagttataaaggttctgtccaaaattcatactttcttttctcctttcagttccatcatttttcggtcagattgtctgccagcctgcaaaatacacatggcaatcacgccaactgttccacctaaagagaagaacaggaagtcaaataataatcgttgcatttttcaattctccttttccaaaatcacatcttcggtagatgtggtctgttgttcgattatcttatagtgcttttccgtcagtttggttgatttgcggatttctttcagataatcaacacctgtttttgctgtgattgtttccagcattttgagtgtcgggtcaacctgccgttgaatccagcgtagggttctgtccagtgtgtatggtcctatgtcaagatttagtacaagttaaaatgaggttttccccattttaacctgccatcagcaattcgtgttgttgcactctacgatacagttcttcataatcatttggtgacatatagtcgcagtgactatgaatccgttttgtgttgtagaatgcctccagatactcgaataccaatcgatatgcatgcccataatcgcggattttgaagcgatttaaccattcacgtttaatcagtgaatgaaatgattcaatacaagcattatcccatgggtaagcttttttagagtagctacactgcatatttgcagtaacacgtttgtattcattagatacatactggctcccgcgatccgagtgtagaatcaatggttcttcgatttttcgtcttgccttagctttatttattgtttcaatcacgcaggacacttccagtgtattagatagcgtccaggcaatgattttcctggaatataaatccatgatactggttagatagacgaagccatctatcgtccagatataggtgatatcagaacaccaaacagtatttggtcgttctggattaaactgttcatctaggatattttgaagttcgttactgaagtcagaatcttttgtggtaattgtccatggttttacccattgagccttgatgcccatttgtttcatatattgccccacggtacgctcggaaatgatttctcctgctttacgtaatacttgagtaattttaggagctccataattctgtttagattcatcgtaaatatccttgattttggcttttactgcttcacgacgcttttcagcattagaaggaacatgtttcagccatgcattataaccagcacgggaaacgccaagtattttcaacattccggagacagaaacacggcgtttagccttgcgggctgcttctgccttctcagcaacttcgagataaatggcttctgtcattttcccagaatgttgattgctttttttaatacatcgagcgcatcttgtgtatcacgtagttcacgctttaaacgtgcgatttcttttgcttcatcctagtataataatgatgtagtcaatcaagactactaggttaataagtttctataaatcagataacagaagaagggattcttccttcatcagatgttatccgtaataataatcatgtctgacggttcctgatagacaccagataaaacataaggtatcatctcttaggataggacaaagaatgtatttctccttgggacactgattatcagtggatacctgcaattgagttaattagtccattcgacagggttttatgttttagctggttgggagccgtaaggcaatacccgtataacacgctaggttgtgtacctgccagatggaaatggattcctatcagaaaggagctattgctcatgtcaaacaaagttatctttaatctcgatgatttattcatctctgttggtattgatgtcggtgctgatttctcctggatgtctatagcacttccaaaccaacaattcgtaggaaaaccttacaaaatcctacataacagtattgattcccttacaaccgctgtttctaaaataaaagaagcagaagagttgtattctttggaaagtcgcattttcctcgaatccacgggaatttatcattacccactcttctgctatcttcgtgataagggttttaactgctctgttattaatcctatcatcactaagaatagcacaaacatcaacatacgaaaagtacataatgatcgttttgattctaaaaaagctgctttggttggtttgaaaccggatttaaaggtttcccttatgccatctgatctcgccttaaactgccgtaacctatgccgtgaatactacgatttaatggataatcgcagtgcctatgtgaataagcttcagggtgaattacgcatggcgtttccacagtatctcggcatcttttccaaggttacaatcaacacttctcttgcactgttggagacttatacatctccctccgcttttcttgaagctgacaagcaagagattattgatatcatcaaatcaacagctcgctttgggcttacatatgatccagaaagaaatggatagtgagctggaaaaagcagacaatgccaatacctggctggattattttgtgaaatatcaggatattgaagaactgtcccgcacagtggtggtagaactgatcaggaaaatcagagtatatgataaaaagaatatagagatcacttttgattttgatgattgttatcagacattgctgaatcaattaccggctatgggagttgatacggtagtagatgatgataataatctgcaggtcaaggtaaaggaggttgtataaaatggcacgaaagagtaggaaaaacattccgacagtagtcggcagtgcaaccgtccagacagaggtgagaagaccattccgggcaggattgtatgccagaatttcaatggaaacagaagaaacattagaaagagggacgatagaaacccaggtggaattgatgaaaaactttgtagcagatacggaagatatttcggttgcggaagtttataaggactcagactattcaggtacaaattttgaccgtcctggattcgtacagatgatggaagatatcaagcatggaaaaatcaattgtgttattgtaaaagatttgtccagacttggaagaaattatgtcgaaaccagcaactatattgaacgagtatttccgttttttcatgtaagattcctggctgtgacagatgatttcgattccttcagagaaggtgtggatcttacagttccactgaagaatattatcaatgagttctattcgaaagaccttgccaaaaagagcagcagcgcaaaaaaagctctttggaaaaaaggaaaatttacaagtgcctgggaaccgtatggttacagaaagtcagaagaagaccatcatcagctgatcgttgatgaagaagctgcagaacatttgaaaagtatattttctatgtatatggatggcaggaactatagtgatattgcaagacagctcaataaagatggagttttatcgccgactttacagagaaaattctataaaaccggatccagaaagaaatggatagtgagctggaaaaagcagacaatgccaatacctggctggattattttgtgaaatatcaagatattgaagaactgtcccgcactgtggtggtagaactgatcaggcaaatccgagtatatgataaaaagaatatagagatcacttttgattttgatgattgttatcagacattgctgagtcaattaccggctatgggagttgatacggtaatagatgatgataataatctgcaggtcaaggtaaaggaggttgtataaaatggcacgaaagagcaggaaaaacattccggaagtagtcagcagtgcaaccgtccagacagagatgagcagaccattccgggcaggattgtatgccagaatttcaatggaaacagaagaaacactagaaagaggaacgatagaaacccaggtggaattgatgaaaaactttgtagcagatacggaagatatttcggttgcgaaagtttataaggactcagactattcaggtacaaattttgaccgtcctggattcgtacagatgatggaagatatcaagcatggaaaaatcaattgtgttattgtaaaagatttgtccagacttggcagaaattatgtcgaaaccagcaattatattgaacgagtattcccgtttttccatgtaagattcctggctgtgacagatgatttcgattctttcagagaaggtgtggatcttacagttccactgaagaatatcatcaatgaattctattcgaaagaccttgccaagaagagtagcagcgcaaaaaaagcactttggaaagagggaaaatttacaagtgcctgggaaccgtatggttacagaaagtcagaagaagaccatcatcagctgattgttgatgatgaagctgcagaacatctgaaaagtatattttctatgtatatggatggcaggaattatagtgatattgcaagacagctcaataaagatggagttttatcgccgactttacagagaaaattctataaaaccgg
